United States Patent 9,902,956 (NUCLEIC ACID AGENTS FOR OVEREXPRESSING OR DOWNREGULATING RNA INTERFERENCE TARGETS AND USES OF SAME IN IMPROVING NITROGEN USE EFFICIENCY, ABIOTIC STRESS TOLERANCE, BIOMASS, VIGOR OR YIELD OF A PLANT) - sequence listing, part 2

SEQ ID NO: 2878 - protein, 766 aa, Hordeum vulgare subsp. vulgare
MASHIVGYPRMGPKRELKFALESFWDGKSSAEDLEKVATDLRASIWKQMSEAGIKYIPSNTFSYYDQVLDTTAMLGAVPDRYSWTGGEIGHSTYFSMARGNATVPAMEMTKWFDTNYHFIVPELSPATKFSYASHKAVSEYKEAKALGVDTVPVLVGPVSYLLLSKAAKGVEKSFSLLSLLDSILPIYKEVVAELKAAGASWIQFDEPTLVKDLAAHELAAFSSAYAELESALSGLNVLIETYFADVPAESYKTLTSLSGVTAYGFDLVRGTKTVELIKSTGIPSGKYLFAGVVDGRNIWADDLAASLSTLQSLESVVGKDKLVVSTSCSLMHTAVDLVNETKLDSEIKSWLAFAAQKVVEVNALGKALAGQKDEAYFAANAAAQASRRSSPRVNNEEVQKAAAALKGSDHRRATPVSARLDAQQKKLNLPVLPTTTIGSFPQTMDLRRVRREYKAKKISEEDYVSAIKEEISKVVKIQEELDIDVLVHGEPERNDMVEYFGEQLSGFAFTANGWVQSYGSRCVKPPIIYGDVSRPNPMTVFWSKMAQSMTPRPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPSTEEIADRVNKMLAVLDTNILWVNPDCGLKTRKYTEVKPALTNMVAAAKLIRTQLASTK

SEQ ID NO: 2879 - protein, 766 aa, Hordeum vulgare subsp. vulgare
MASHIVGYPRMGPKRELKFALESFWDGKSSAEDLEKVATDLRASIWKQMSEAGIKYIPSNTFSYYDQVLDTTAMLGAVPDRYSWTGGEIGHSTYFSMARGNAAVPAMEMTKWFDTNYHFIVPELSPATKFSYASHKAVSEYKEAKALGVDTVPVLVGPVSYLLLSKAAKGVEKSFSLLSLLDSILPIYKEVVAELKAAGASWIQFDEPTLVKDLAAHELAAFSSAYAELESALSGLNVLIETYFADVPAESYKTLTSLSGVTAYGFDLVRGTKTVELIKSTGIPSGKYLFAGVVDGRNIWADDLAASLSTLQSLESVVGKDKLVVSTSCSLMHTAVDLVNETKLDSEIKSWLAFAAQKVVEVNALGKALAGQKDEAYFAANAAAQASRRSSPRVNNEEVQKAAAALKGSDHRRATPVSARLDAQQKKLNLPVLPTTTIGSFPQTMDLRRVRREYKAKKISEEDYVSAIKEEISKVVKIQEELDIDVLVHGEPERNDMVEYFGEQLSGFAFTANGWVQSYGSRCVKPPIIYGDVSRPNPMTVFWSKMAQSMTPRPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPSTEEIADRVNKMLAVLDTNILWVNPDCGLKTRKYTEVKPALTNMVAAAKLIRTQLASTK

SEQ ID NO: 2880 - protein, 766 aa, Hordeum vulgare subsp. vulgare
MASHIVGYPRMGPKRELKFALESFWDGKSSAEDLEKVATDLRASIWKQMSEAGIKYIPSNTFSYYDQVLDTTAMLGAVPDRYSWTGGEIGHSTYFSMARGNATVPAMEMTKWFDTNYHFIVPELSPATKFSYASHKAVSEYKEAKALGVDTVPVLVGPVSYLLLSKAAKGVEKSFSLLSLLDSILPIYKEVVAELKAAGASWIQFDEPTLVKDLAAHELAAFSSAYAELESALSGLNVLIETYFADVPAESYKTLTSLSGVTAYGFDLVRGTKTVELIKSTGIPSGKYLFAGVVDGRNIWADNLAASLSTLQSLESVVGKDKLVVSTSCSLMHTAVDLVNETKLDSEIKSWLAFAAQKVVEVNALGKALAGQKDEAYFAANAAAQASRRSSPRVNNEEVQKAAAALKGSDHRRATPVSARLDAQQKKLNLPVLPTTTIGSFPQTMDLRRVRREYKAKKISEEDYVSAIKEEISKVVKIQEELDIDVLVHGEPERNDMVEYFGEQLSGFAFTANGWVQSYGSRCVKPPIIYGDVSRPNPMTVFWSKMAQSMTPRPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPSTEEIADRVNKMLAVLDTNILWVNPDCGLKTRKYTEVKPALTNMVAAAKLIRTQLASTK

SEQ ID NO: 2881 - protein, 1045 aa, Zea mays
MAAGTEAFEAYFRRADLDQDGRISGQEAVAFFQGANLPQPVLAQVWMHADQNKTGFLGRPEFFNALRLVTVAQSGRQLTPDIVQSALYGPAAARIPAPKIAAGAARSQMGAAGAPRPQGSAAMTPGQVGAAQMNPAGTPRPQGSGMMPTSTQVSMLQVNPGAAPRPQGISSMMPAASQGGALQATQFAAPRAMQPQPPNLGITQQQPSSTGFMRPPQVGTPAASFQAQAPGINQGLVHGGSMEGSISWQGGNAASVGGIPRAIPGAAPSQTTRGFGPGLPSTMGMVPGQQVQAMSSSPLPPQSNSAVLPQNSKALVLSGNGPASSSGSSTDIFSALTQPKPSLSAPQTSSIPSSSSFMATPTGSQNLTNLTQFGSLQGSSQPQQTQPIVKSIPAPATPVVSAGISNSASQWPKITQPDIQKYMKVFGDVDRDRDGKITGAEARTLFLSWRLPREVLKQVWDLSDQDNDGMLSLREFCIALYLMERHRAGIPLPPALPDSLRHDETLLRATGLPSTAYNSPSWQHNQGGLPQRGPGAPGVPAGGVRPPLPSHLHSQTDGASRQGQPRSHMPGMDNHVVIQGNKDDKSALNQAAQEVVDAPKKVEVEKQVLDSREKLEYYRTKMQDLVLYKSRCENRLNEITERASSDKREVESLAKKYEEKYKQVAELASKLAVEEAAYRDVQERKVELHDALIKMVQGGSVDGLLQVRADRIQYQLEEMEKALSERCKHFELKFKPSASVELPSGWEPGPQEGLIEWDEDWDKFEDEGFSIVKDNGTIQENPVSAENGKVPSLWDDGDMSPVASSNGHIKEERRYSGGDQVAESEIAYDFGDESVRSPGSAGRSASGSPFKSSGFGMHDSSPSKRESYSDHGGSESVFGDKFADETSWNFDDQDTDSVWGSTVLNTEADQRGGTHNSFFGSEAGSPSGASVFGKKRNSFFDDSVPSSPAYTSGFSPKFGESRDDSSSYNFGRFDSFRSQDTGSFPQESRFSRFDSISSSKGENVSGFDTGNSSRNFGRFDSFDDADPFGSSGPFKASGSRSPPKF

SEQ ID NO: 2882 - protein, 1045 aa, Sorghum bicolor
MAGTEAFEAYFRRADLNQDGRISGQEAVAFFQGANLPQQVLAQVWMHADQNKTGFLGRPEFFNALRLVTVAQSGRQLTPDIVQSALYGPAAARIPAPKIAAGPAPAQMGAAGAPRPQGSAAMTPTPGQVGAAQMNPAATPRPQGSGMMPTSSQVSMPQVNPGAAPRPQGISSMMPAASQGGALQASQFAGPRAMQPQPPNLGITQQQPSSTGFMRPPQVGAPATSFQAQAPGINQGLVGGGSMGGSVGWQGGNAASVGGIPQAIPGAAPLQTTRGGFGPGLPSTMGMAPGQQVQAMSSSPLPMQSNSAVLPQDSKALVLSGNGPASSSGSSADIFSALTQPKPSVSAPAPQTSSIPSSSSFMPTPTGSQNLTNLAQFGSLQGSSQPQQTQPVVKPSPAPAAPVVSVGISNSASQWPKITQSDIQKYMKVFGDVDRDRDGKITGAEARTLFLSWRLPREVLKQVWDLSDQDNDGMLSLREFCIALYLMERHRAGTPLPPALPDSLRHDETLLRATGLPSTAYNGPSWQHNQGGLPQRGPGAAGVPGGVRPPLPPHLHSTDGASRPGQPRSHMPGMDNHVVNQGNKDEKSGVNQAAQEVVDAPKKVEVEKQVLDSREKLEYYRTKMQDLVLYKSRCDNRLNEITERASSDKREVESLAKKYEEKYKQVAELASKLAVEEAAYRDVQERKVELHDALIKMVQGGSVDGLLQVRADRIQYQLEEMEKALSERCKHFGLQFKSSASVELPSGWEPGPQEGLIEWDEDWDKFEDEGFSIVKDNGTIQENPVSAENGKVPSLWDDGDDMSPVASSNGHIKEERRYSGGDQVAESEIAYDFGDESVRSPGSAGRSASGSPFKSSRFGMHDSSPSKRESYSDHGGSESVFGDKFADETSWNFDDQDTDSVWGSTALNTEADQHGGTHSSFFGSEAGSPSGASVFGKKRSTFFDDSVPSSPAYTSGFSPKFGESRDDSSFGRFDSFRSQDTGFFPQESRFSRFDSISSSKGENVSGFDTGNSSQNFGRFDSFDDADPFGSSGPFKASGSRSPPKF

SEQ ID NO: 2883 - protein, 1068 aa, Oryza sativa Japonica Group
MAGMEAFEAYFRRADLNQDGRISGQEAVAFFQGANLPQQVLAQVWMHADKNKTGFLGRPEFFNALRLVTVAQSGRQLTPDIVQSALYGPAAARIPAPKIAGGGQAPPQMAAAGAPRPQVNAAVSPAPGQAGAPQPQMNVAGAPRPQGSGMMPGSAQIGGSQQVNAGAVPRPQGVNSMMPAASQGGALQPTQFATQRGMQSQPPSMGFNQQPPPSSTGFMRPTQPGAPAASLQGQGPGINQVPLGGGSMGAPAGWRGGNVGSVGGLPQATPGATAPQQATPGGFGLTLSSTMGMAPGQQAQGTPPSSMPPQSNSAVSAQDSKALVLSGNGSASGLGASNDIFSALTQPKSNVSTLSFPTSMAPNSSSFMSTPSGSQNLSNLAQFGSQQGIPTVSSGGSQPQQTHPITKPSVPAPTVSGVSAGVSNSASQWPKVTQSDIQKYTKVFADVDRDRDGKITGAEARTLFLSWRLPREILKQVWDLSDQDNDGMLSLREFCIALYLMERHRAGTPLPPALPDSLKYDEVLLRATGLPSTAYNGPSWQQNQGLPHKGPGAAGMPATGVRQPLPPHLQAQMDGANRPGQPRPHMPGMDNHAAPQANKDDGSGANSAVQEDAPKKVEVEKQVLDSREKLEYYRTKMQDLVLYKSRCDNRLNEITERASSDKREVESLAKKYEEKYKQVAELASKLAVEEHAFRDVQERKVELHDALVKMVQGGSVDGLLQVRADRIQYQLEEMEKAFSERCKHFGLQFKPSASVELPFGWEPGKQEGAIEWDEDWDKFEDEGFGFVKDNGTIVENPVASENVKVPSLWNDMDESPVASSNGHIKAERHYRAGDHAAESDLGYDFGEESVRSPSSAGRSASGSPFVSSNFAMHDSSPSKKETYSDHGGSESIFGDKYADETSWNFDDQDTESVWGSNAMNNESDHHGSAHNSFFGSDDFGVNPVRVGSPSGASTYGKKKSSFFDDSVPSSPAYTSGFSPKFSESRDDSSSYNLGRFDSFRSQESGFFPQESRFSRFDSINNSKGENVTGFDSPKSSTNFGRFDSFDDADPFGSSGPFKASGSRSPPKF

SEQ ID NO: 2884 - protein, 1051 aa, Oryza sativa Japonica Group
MAGMEAFEAYFRRADLNQDGRISGQEAVAFFQGANLPQQVLAQVWMHADKNKTGFLGRPEFFNALRLVTVAQSGRQLTPDIVQSALYGPAAARIPAPKIAGGGQAPPQMAAAGAPRPQVNAAVSPAPGQAGAPQPQMNVAGAPRPQGSGMMPGSAQIGGSQQVNAGAVPRPQGVNSMMPAASQGGALQPTQFATQRGMQSQPPSMGFNQQPPPSSTGFMRPTQPGAPAASLQGQGPGINQVPLGGGSMGAPAGWRGGNVGSVGGLPQATPGATAPQQATPGGFGLTLSSTMGMAPGQQAQGTPPSSMPPQSNSAVSAQDSKALVLSGNGSASGLGASNDIFSALTQPKSNVSTLSFPTSMAPNSSSFMSTPSGSQNLSNLAQFGSQQGIPTVSSGGSQPQQTHPITKPSVPAPTVSGVSAGVSNSASQWPKVTQSDIQKYTKVFADVDRDRDGKITGAEARTLFLSWRLPREILKQVWDLSDQDNDGMLSLREFCIALYLMERHRAGTPLPPALPDSLKYDEVLLRATGLPSTAYNGPSWQQNQGLPHKGPGAAGMPATGVRQPLPPHLQAQMDGANRPGQPRPHMPVLIHFEQANSSMVEVEKQVLDSREKLEYYRTKMQDLVLYKSRCDNRLNEITERASSDKREVESLAKKYEEKYKQVAELASKLAVEEHAFRDVQERKVELHDALVKMVQGGSVDGLLQVRADRIQYQLEEMEKAFSERCKHFGLQFKPSASVELPFGWEPGKQEGAIEWDEDWDKFEDEGFGFVKDNGTIVENPVASENVKVPSLWNDMDESPVASSNGHIKAERHYRAGDHAAESDLGYDFGEESVRSPSSAGRSASGSPFVSSNFAMHDSSPSKKETYSDHGGSESIFGDKYADETSWNFDDQDTESVWGSNAMNNESDHHGSAHNSFFGSDDFGVNPVRVGSPSGASTYGKKKSSFFDDSVPSSPAYTSGFSPKFSESRDDSSSYNLGRFDSFRSQESGFFPQESRFSRFDSINNSKGENVTGFDSPKSSTNFGRFDSFDDADPFGSSGPFKASGSRSPPKF

SEQ ID NO: 2885 - protein, 1085 aa, Hordeum vulgare subsp. vulgare
MAGMEAFEAYFRRADLNQDGRISGQEAVAFFQGASLPQQVLAQVWMHADQSKTGFLGRPEFFNALRLVTVAQSGRQLTPDIVQSALYGPAAARIPPPKIAGQAGVAAPRPQGNVAAPAPAPGQAGATQMNPAAAGAPRPQGSGMMPTSAAAPRPQGSGMMPTSAAAPRPQGSGMMPTSTQFAGAPQANAGAVPRPQGISSMMPAASQGGAMPPNQFSGPRGTQSQSPNMGYAQQLLTSSTGFMRPPPQVGAPATSLQPTGMNKSPLGGGSMGGSVGWQGGNVGSFGGISQPSPGAAVPSQPTSGGFGLGMSSSMGMVPGQQTHALSSSSLPPQSNSAVLPADSRALVLSGNGPASGSGADTDIFSALTQPKPSTSTPALLTGTMPNSSSFMSKPTGSQNLANLTQPGSLQSTPTVSYGTSQPQQTQPITKPSVPAPGVSAGVSNSTSQWPKVNQSDIQKYTKVFGDVDRDRDGKITGAEARTLFLSWRLPRDVLKQVWDLSDQDNDGMLSLREFCIALYLMERNRAGTPLPPSLPDSLKFDETLLRATGLPSTAYNAPSWQPNQGLPHRGPGAPGLPTGGVRPPLPQMHSQTDGATRPGQPRPHMPGMDNHAAAQGIKDDRSGVNSAAQEAPKKVEVEKQVLDSREKLEYYRTKMQDLVLYKSRCDNRLNEITERASSDKREVELLSKKYEEKYKQVAELASKLAVEEAAFRDVQERKVELNDALIKMVQGGSVDGLLQVRADRIQHQLEEMEKAFNERCKHFGLQFKPSATVELPFGWEPGQQEGAVEWDEDWDKFEDEGFGLVKDNGTIVENPASSENANTSSLWDDGVSTDGMSPVASSNGHIKDVRHYRAGDQAPESELAYDFGDESVRSPGSAGRSASGSPFKSSRFGVHDSSPTKKGTYSDHGGSESVFGDNYGDETTWNFDDQDTESVWGSNAMNEPGHHGSNSFFGSDDFNVDPVRVGSPSGASVYGKKSTFFDDSVPSSPAYTSGFSPKFGESRDDSSSYNFGRFDSFRSQDGAVPQESRFSRFDSVTSSKGESAAGFDSSNSSRNFGRFDSFDEADPFGSTGPFKASGARSPPKF

SEQ ID NO: 2886 - protein, 920 aa, Sorghum bicolor
MELVGRSFLPGSAAAASPAGRERRRGGPCFAAVGREGSAHKRRPSLRSTAPVGALAERVVVTPAPPEERAGTAPPEPHPQSVAARAVVTVRRRRKEDAKRRVAEQLDAYADRVGRSVLLELISTETDPRKGGPKKSRRSALVGWFEKKDVKAERVVYTADFTVDGCFGEPGAVTVLNRHQREFFIESIVVEGFPSGPAHFTCNSWVQPTRVDRNPRVFFTNKPYLPAETPPGLQELRRQELSDLRGEGGADTTGERRITDRVWEYDVYNDLGNPDKGAEFARPILGGEQQLPYPRRMRTGRPKTFTDDRAESRVEYPEPIYVSRDEEFEEGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPMSKLDPAVYGPPESAITEEHIIGQLDGMSVRQALQDNRLYMLDYHDIFLPFLDRINAQDGRKAYGTRTLFFLTAAGTLKPIAIELCLPPMTDGCARAKRVFTPPADATSNWLWQLAKAHVCSNDAGVHQLINHWLRTHACMEPFIISAHRQLSAMHPIFKLLKPHMRYTLKINALARQILINGDGVIESGFTPGRYCMEMSSFAYQELWRLDQEGLPADLIRRGMAVEDPTQPHGLRLLIEDYPYATDGLLLWDAITRWCDAYVAMYYPSDQAVQGDTELQSWYREAVQTGHADKRGAPWWPRLSTPGDLASLLTTLLWLTSAQHAALNFGQYPLGGYIPNRPPLMRRLVPADGDPEYAHLVADPHRFFLSALPSLTQTTTFMTVIDTLSTHSADEQYLGERPDEAWTADPAALAAAREFADEVRRAEEEIDRRNADTGRRNRCGAGVLPYELMAPTSGPGITCRGIPNSVTI

SEQ ID NO: 2887 - protein, 924 aa, Sorghum bicolor
MASAMELVGRSFLPGSAAAASPAGRERRRGGPCFAAVGREGSAHKRRPSLRSTAPVGALAERVVVTPAPPEERAGTAPPEPHPQSVAARAVVTVRRRRKEDAKRRVAEQLDAYADRVGRSVLLELISTETDPRKGGPKKSRRSALVGWFEKKDVKAERVVYTADFTVDGCFGEPGAVTVLNRHQREFFIESIVVEGFPSGPAHFTCNSWVQPTRVDRNPRVFFTNKPYLPAETPPGLQELRRQELSDLRGEGGADTTGERRITDRVWEYDVYNDLGNPDKGAEFARPILGGEQQLPYPRRMRTGRPKTFTDDRAESRVEYPEPIYVSRDEEFEEGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPMSKLDPAVYGPPESAITEEHIIGQLDGMSVRQALQDNRLYMLDYHDIFLPFLDRINAQDGRKAYGTRTLFFLTAAGTLKPIAIELCLPPMTDGCARAKRVFTPPADATSNWLWQLAKAHVCSNDAGVHQLINHWLRTHACMEPFIISAHRQLSAMHPIFKLLKPHMRYTLKINALARQILINGDGVIESGFTPGRYCMEMSSFAYQELWRLDQEGLPADLIRRGMAVEDPTQPHGLRLLIEDYPYATDGLLLWDAITRWCDAYVAMYYPSDQAVQGDTELQSWYREAVQTGHADKRGAPWWPRLSTPGDLASLLTTLLWLTSAQHAALNFGQYPLGGYIPNRPPLMRRLVPADGDPEYAHLVADPHRFFLSALPSLTQTTTFMTVIDTLSTHSADEQYLGERPDEAWTADPAALAAAREFADEVRRAEEEIDRRNADTGRRNRCGAGVLPYELMAPTSGPGITCRGIPNSVTI

SEQ ID NO: 2888 - protein, 918 aa, Zea mays
MASAMKLLGRSSLASPAAAAPGRERRGGPCFAAVGREGSAHRRRSSLRSTAPVGALAERVVVTPAPPERAGAGPPEPHPQSVAARAVVTVRRRRKEDAKRRVAEQLDAYADRVGRSVLLELISTETDPRKGGPKKSRRSALVGWFEKKDVKTERVVYTADFTVDGSFGEPGAVTVLNRHQREFFIESIVVEGFPSGPAHFTCNSWVQPTRVDRNPRVFFTNKPYLPAETPPGLQELRRQQLSDLRGEGADTGERRITDRVWEYDVYNDLGNPDKGAEFARPVLGGEQQLPYPRRMRTGRPKTITDDRAESRVEYPEPIYVSRDEEFEDGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPMSKLDPAVYGPPESAITEEHIIGQLDGMSVQQALQDDRLYMLDYHDIFMPFLDRINALDGRKAYGTRTLFFLTAAGTLKPIAIELCLPPMTDGCARAKRVFTPPADATSNWLWQLAKAHVCSNDAGVHQLINHWLRTHAAMEPFIIAAHRHLSTMHPIFKLLKPHMRYTLKINALARQILINGDGVIESGFTPGRYCMEMSSFAYRELWRLDQEGLPADLIRRGMAVEDPTQPHGLRLLIEDYPYATDGLLLWSAIRRWCDAYVAMYYPSDESVQGDTELQSWYREAVHTGHADKRDAPWWPRLSTPADLASLLTTLLWLTSAQHAALNFGQYPLGGYIPNRPPLMRRLVPAEGDPEYAHLVADPHRFFLSALPSLTQTTTFMTVIDTLSTHSADEQYLGERPDEAWTADPAALAAAREFADEVRRAEEEIERRNADTGRRNRCGAGVLPYELMAPTSGPGITCRGVPNSVTI

SEQ ID NO: 2889 - protein, 941 aa, Zea mays
MASAMKLLGRSSLASPAAAAPGRERRGGPCFAAVGREGSAHRRRSSLRSTAPVGALAERVVVTPAPPERAGAGPPEPHPQSVAARAVVTVRRRRKEDAKRRVAEQLDAYADRVGRSVLLELISTETDPRKGGPKKSRRSALVGWFEKKDVKTERVVYTADFTVDGSFGEPGAVTVLNRHQREFFIESIVVEGFPSGPAHFTCNSWVQPTRVDRNPRVFFTNKPYLPAETPPGLQELRRQQLSDLRGEGADTGERRITDRVWEYDVYNDLGNPDKGAEFARPVLGGEQQLPYPRRMRTGRPKTITGKPPLSHDRAESRVEYPEPIYVSRDEEFEDGKNEMLSEGALKALLHNFMPLLVSSVSPDIRDFAGFHDVDNLFKEGLRLKQALQDQLFQKIPFVRKIQENSEGLLRYDTPDIIKSKPAPMRLPPPPSMIHGEDKFAWLRDDEFARQALAGINPVNIERLQAFPPMSKLDPAVYGPPESAITEEHIIGQLDGMSVQQALQDDRLYMLDYHDIFMPFLDRINALDGRKAYGTRTLFFLTAAGTLKPIAIELCLPPMTDGCARAKRVFTPPADATSNWLWQLAKAHVCSNDAGVHQLINHWLRTHAAMEPFIIAAHRHLSTMHPIFKLLKPHMRYTLKINALARQILINGDGVIESGFTPGRYCMEMSSFAYRELWRLDQEGLPADLIRRGMAVEDPTQPHGLRLLIEDYPYATDGLLLWSAIRRWCDAYVAMYYPSDESVQGDTELQSWYREAVHTGHADKRDAPWWPRLSTPADLASLLTTLLWLTSAQHAALNFGQYPLGGYIPNRPPLMRRLVPAEGDPEYAHLVADPHRFFLSALPSLTQTTTFMTVIDTLSTHSADEQYLGERPDEAWTADPAALAAAREFADEVRRAEEEIERRNADTGRRNRCGAGVLPYELMAPTSGPGITCRGVPNSVTI

SEQ ID NO: 2890 - protein, 916 aa, Zea mays
MASAMELLGRSFAPGHAAAAPRRGGGPCFAAVGREGSGAHRRRSSSSSSLRSTAPVDALAERVVAPPERAEAVPPEPSVAARAVVTVRRSRKRDAKCRVAERLDACADWVGRSVLLELISTETDPRKGGPKKSRRSALVGWFGEKDVKAERVVYTADFNVDGSFGEPGAVAVLNRHQREFFVESIVVEGFPSGPAHFTCYSWVQPTRVHRDPRVFFTNKPYLPAQTPPGLRELRRLELSDLRGEGAGTGGERRTTDRVWEYDVYNDLGNPDMGAEFARPILGGDQQLPYPRRMRTGRPKTFTDDRAESRVEYPEPIYVSRDEEFEEGKNEMLSEGALKALLHNFMPLLVSSVSPDFRDFAGFHDVDNLFKEGLRLKQALQDQLFQKIPFVRKVQENSEGLLRYDTPDIIKRDKFAWLRDDEFARQALAGINPVNIERLQAFPPMSKLDPAVYGPPESAITEEHIIGRLDGMSVQQALEDNRLYMLDYHDIFLPFLDRINAQDGRKAYGTRTLFFLTGAGTLKPIAIELRLPPMTDGCARAKRVLTPPADATSNWLWQLAKAHVCSNDAGVHQLINHWLRTHACMEPFIIAAHRQMSAMHPIFKLLKPHMRYTLKINALARQILINGDGVIESGFTPGRYCMEMSSFAYRELWRLDQEGLPADLIRRGMAVEDPTKPHGLRLLIEDYPYATDGLLLWSAITRWCGAYVATYYPSDESVQADTELQSWYTEAVQTGHADKRGAPWWPRLTTPGDLASLLTTLLWLTSAQHAALNFGQYPLGGYIPNRPPLMRRLVPAEGDPEHAHLVADPHRFFLSALPGLTQATTFMTVIDTLSTHSADEQYLGERPDEAWTADPAALAAEREFADEVRRAEEEIGRRNTDAGRRNRCGAGVLPYELMAPTSGPGITCRGVPNSVTI

SEQ ID NO: 2891 - protein, 921 aa, Zea mays
MASAMELLGRSFAPGHAAAAPRRGGGPCFAAVGREGSGAHRRRSSSSSSLRSTAPVDALAERVVAPPERAEAVPPEPSVAARAVVTVRRSRKRDAKCRVAERLDACADWVGRSVLLELISTETDPTALVGWFGEKDVKAERVVYTADFNVDGSFGEPGAVAVLNRHQREFFVESIVVEGFPSGPAHFTCYSWVQPTRVHRDPRVFFTNKPYLPAQTPPGLRELRRLELSDLRGEGAGTGGERRTTDRVWEYDVYNDLGNPDMGAEFARPILGGDQQLPYPRRMRTGRPKTFTGKPPLLPPPPPPPAHYDRAESRVEYPEPIYVSRDEEFEEGKNEMLSEGALKALLHNFMPLLVSSVSPDFRDFAGFHDVDNLFKEGLRLKQALQDQLFQKIPFVRKVQENSEGLLRYDTPDIIKRDKFAWLRDDEFARQALAGINPVNIERLQAFPPMSKLDPAVYGPPESAITEEHIIGRLDGMSVQQALEDNRLYMLDYHDIFLPFLDRINAQDGRKAYGTRTLFFLTGAGTLKPIAIELRLPPMTDGCARAKRVLTPPADATSNWLWQLAKAHVCSNDAGVHQLINHWLRTHACMEPFIIAAHRQMSAMHPIFKLLKPHMRYTLKINALARQILINGDGVIESGFTPGRYCMEMSSFAYRELWRLDQEGLPADLIRRGMAVEDPTKPHGLRLLIEDYPYATDGLLLWSAITRWCGAYVATYYPSDESVQADTELQSWYTEAVQTGHADKRGAPWWPRLTTPGDLASLLTTLLWLTSAQHAALNFGQYPLGGYIPNRPPLMRRLVPAEGDPEHAHLVADPHRFFLSALPGLTQATTFMTVIDTLSTHSADEQYLGERPDEAWTADPAALAAEREFADEVRRAEEEIGRRNTDAGRRNRCGAGVLPYELMAPTSGPGITCRGVPNSVTI

SEQ ID NO: 2892 - protein, 899 aa, Oryza sativa Japonica Group
MRGGAGMCFASMEAAGSRGMGKGASRRRTARSTAPVGALVERVVVAPAPVEQQRGAGRPEAHPQSVAARAVVTVRRRRKEDAKDRFAEQLDALADRVGRSVLLELVSTETDPRKGTPKKSKPSALVGWFDKKDVKAERVVYTAEFAVDAGFGEPGAVTVLNRHQREFYIESIVVEGFPTGPAHFTCNSWVQPTRVSRDRRVFFSNRPYLPSETPPGLRELRLRELADLRGDGTGERRITDRVYDYDVYNDLGNPDKGVASARPVLGGEQMPYPRRMRTGRPSTATDASAESRVEYPEPIYVSRDEEFEEGKNEMLSEGAIKALLHNFMPLLVSSVSPDIRDFAGFHDVDNLFKEGLRLKQALHDQLFQKIPFVRKIQENSEGLLRYDTPDIIKKDKFAWLRDDEFARQALAGINPVNIERLQAFPPVSKLDPAVYGPPESAITEEHIIGHLDGMSVQEAVEGSRLYMLDYHDIFLPFLDRINAQDGRKAYGTRAVFFLTAAGTLKPIAIELCLPPMTDGCKRAKRVFTPPADATSNWLWQLAKAHVCSNDAGVHQLINHWLRTHACMEPFIIAAHRQMSAMHPIFKLLKPHMRYTLKINALARQILINGDGVIESGFTPGNVCMEMSAFAYRELWRLDQEGLPADLIRRGMAVEDPSQPHGLRLLIEDYPYAADGLLLWSAISRWCEAYVAAYYPSDEAVQADYELQSWYAEAVQSGHADKRGAPWWPRLSTPGDLASLLTTLVWLCSAQHAALNFGQYPLGGYIPNRPPLMRRLVPAEGDPEYAHLVADPHRFFLSALPSLTQTTTFMTVIDTLSTHSADEEYLGERPDEAWTADPAALAAAREFAADVRRAEEEIERRNADPSRRNRCGAGVLPYELMAPSSGPGITCRGVPNSVTI

SEQ ID NO: 2893 - protein, 911 aa, Hordeum vulgare subsp. vulgare
MPPMELLGRSFLQAAGSASTAAPRGGRERGLCFASLGGRPSRRTVRSKAPVGALAERVVLTSAPAERVARPEAHPQSVAARAVVTVRRKRKVEVKEQVAEQMDAYADRVGRSVLLELISTETDPRKGDPKKSNKSGLVGWFEKRDVKAELVVYTAEFTVDAAFGEPGAVTVLNRHQREFFIESILVEGFPSGPAHFTCNSWVQPSRIDPAPRVFFTNKPYLPSQTPPGLRDVRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSKLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQLHGLRLLIEDYPYATDGLLLWSAIARWCQAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAAQEFAAEVRRAEEEIERRNADPARRNRCGAGVLPYELMAPSSGPGITCRGVPNSVTI

SEQ ID NO: 2894 - protein, 911 aa, Hordeum vulgare subsp. vulgare
MPPMELLGRSFLQAAGSASTAAHRGGRERGLCFASLGGRPSRRTVRSKAPVGALAERVVLTSAPAERVARPEAHPQSVAARAVVTVRRKRKVEVKEQVAEQMDAYSDRVGRSVLLELISTETDPRKGDPKKSNKSGLVGWFEKRDVKAELVVYTAEFTVDAAFGEPGAVTVLNRHQREFFIESILVEGFPSGPAHFTCNSWVQPSRIDPAPRVFFTNKPYLPSQTPPGLRDVRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSKLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQPHGLRLLIEDYPYATDGLLLWSAIARWCQAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERSNEEWTADPAALAAAQEFAAEVRRAEEEIERRNADPARRNRCGAGVLPYELMAPSSGPGITCRGVPNSVTI

SEQ ID NO: 2895 - protein, 911 aa, Hordeum vulgare subsp. vulgare
MPPMELLGRSFLQAAGSASTAAPRGGRERGLCFASLGGRPSRRTVRSKAPVGALAERVVLTSAPAERVARPEAHPQSVAARAVVTVRRKRKVEVKEQVAEQMDAYADRVGRSVLLELISTETDPRKGDPKKSNKSGLVGWFEKRDVKAELVVYTAEFTVDAAFGEPGAVTVLNRHQREFFIESILVEGFPSGPAHFTCNSWVQPSRIDPAPRVFFTNKPYLPSQTPPGLRDVRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSKLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGTAVEDASQLHGLRLLIEDYPYATDGLLLWSAIARWCQAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAAQEFAAEVRRAEEEIERRNADPARRNRCGAGVLPYELMAPSSGPGITCRGVPNSVTI

SEQ ID NO: 2896 - protein, 305 aa, Zea mays
MAMQAARRLASLKLQRRLLLPSQAESPSISIPTAAAAAAFLHSHATSFGYKQVREEDKSKLVGNVFSSVASSYDLMNDLMSVGLHRLWKDRLISKLNPFSGMKHLDVAGGTGDVAFRVLERVKSVGHRAMQGTLTETEEGTHIYVCDINPNMLNVGKKRAAERGYSEEHCLSWIQGDAEALSFEDGSMDGYTIAFGIRNVTHIEKALSEAYRVLKQGGRFLCLELSHVDVPIFKEIYDVYSFSMVPAIGELVAGDRQSYQYLVESIRRFPNQEKFAQMIQEAGFQRVEYENLVGGVVAIHSGLKL

SEQ ID NO: 2897 - protein, 305 aa, Zea mays
MAMQAARRLASLKLQRRLLLPSQAESPSISIPTAAAAAAFLHSHATSFGYKQVREEDKSKLVGNVFSSVASSYDLMNDLMSVGLHRLWKDRLISKLNPFPGMKHLDVAGGTGDVAFRVLEIVKSVGHRAMQGTLTETEEGTHIYVCDINPNMLNVGKKRAAERGYSEEHCLSWIQGDAEALSFEDGSMDGYTIAFGIRNVTHIEKALSEAYRVLKQGGRFLCLELSHVDVPIFKEIYDVYSFSMVPAIGELVAGDRQSYQYLVESIRRFPNQEKFAQMIQEAGFQKVEYENLVGGVVAIHSGLKL

SEQ ID NO: 2898 - protein, 302 aa, Zea mays
MAMQATRRLASLSLQRRLLLPSQTEAPSIPTAAAAAFLHSHATSFGYRQIREEDKSKLVGNVFSSVASSYDLMNDLMSVGLHRLCKDRLISKLNPFPAMKHLDVAGGTGDVAFRVLERIKSVSHRAMQGTLTETEEDTHIYVCDINPNMLNVGKKRAAERGYSEEHCLSWIQGDAEALSFEDGSMDGYTIAFGIRNVTHIEKALSEAYRVLKRGGRFLCLELSHVDVPVFKEIYDVYSFSVIPTIGELVAGDRQSYQYLVESIRRFPNQEKFAQMIQEAGFQRVEYENLVGGVVAIHSGLKL

SEQ ID NO: 2899 - protein, 294 aa, Oryza sativa Japonica Group
MALRSAAGRLASSSRRRLLSPPTSIHTAFLHSHATSFGYKQVAEEDKSKLVGNVFSSVASSYDLMNDLMSVGLHRLWKDRLISKLNPFPGMKHLDVAGGTGDVAFRALERINSVSHRAMQGTLTDIEEETQIYVCDINPNMLNVGKKRASERGYKEGHCLSWIQGDAEALSFEDGSMDGYTIAFGIRNVTHIEKALSEAYRVLKRGGRFLCLELSHVDVPLFKEIYDVYSFSVIPAVGELVAGDRQSYQYLVESIRRFPNQEKFAQMIQEAGFERVEYENLVGGVVAIHSGLKL

SEQ ID NO: 2900 - protein, 294 aa, Oryza sativa Indica Group
MALRSAAGRLASSSRRRLLSPPTSIHTAFLHSHATSFGYKQVAEEEKSKLVGNVFSSVASSYDLMNDLMSVGLHRLWKDRLISKLNPFPGMKHLDVAGGTGDVAFRALERINSVSHRAMQGTLTDIEEETQIYVCDINPNMLNVGKKRASERGYKEGHCLSWIQGDAEALSFEDGSMDGYTIAFGIRNVTHIEKALSEAYRVLKRGGRFLCLELSHVDVPLFKEIYDVYSFSVIPAVGELVAGDRQSYQYLVESIRRFPNQEKFAQMIQEAGFERVEYENLVGGVVAIHSGLKL

SEQ ID NO: 2901 - protein, 299 aa, Hordeum vulgare subsp. vulgare
MALRAAAARLASSSLRRHHGHLLPAASAASHAAFLHSHATSFGFKQVREDEKSKLVGNVFSSVASSYDVMNDLMSAGLHRLWKDRLISKLNPFPGMKHLDVAGGTGDVAFRVVERIKSVSHRAMQGTLTDMEEDTHIYVCDINPNMLEVGKKRAAEKGYNEEKCLSWVQGDAEALSFEDGSMDGYTIAFGIRNVTHIEKALSEAYRVLKKGGRFLCLELSHVDVPVFKDIYDIYSFSVIPAVGELVAGDRQSYQYLVESIRRFPKQEKFAQMIQEAGFEAVEYENLVGGVVAIHSGVKL

SEQ ID NO: 2902 - protein, 230 aa, Sorghum bicolor
MNDFMSVGLHRLWKDRLVSKLNPFPGMKHLDVAGGTGDVAFRVLERIKSVGHRAMQGTLTENEEDTHIYVCDINPNMLNVGKKRAAERGYSEEHCLSWIQGDAEALSFEDGSMDGYTIAFGIRNVTHIEKALSEAYRVLKRGGRFLCLELSHVDVPVFKEIYDVYSFSVIPTIGELVAGDRQSYQYLVESIRRFPNQEKFAQMIQEAGFQRVEYENLVGGVVAIHSGLKL

SEQ ID NO: 2903 - protein, 289 aa, Populus trichocarpa
MALKLVSRKLGSKFLPMLSSTSPLHSHATSFGFKHVREEEKSQMVGNVFSSVASNYDLMNDLMSGGLHRLWKDRLVSMLNPFPGMKHLDVAGGTGDVAFKILDGISSIKRRANQDPINDHLQEETQIHVCDINPNMLNVGKKRAIERGLGEDKSLIWVEGDAEALSFEDNTMDGYTIAFGIRNVTHIEKVLAEAYRVLKHGGRFLCLELSHVEVPVFKELYDYYSFSVIPAVGELVAGDRDSYQYLVESIRRFPPQVKFASMIADAGFQKVEYENLVGGVVAIHSGLKI

SEQ ID NO: 2904 - protein, 663 aa, Sorghum bicolor
MASTRRLSRVLLTELGSIAMLTLLLVLLLPASHARVCPPCGTTAVPYPLSTGDGCGDPAYKVRCAANSSLVFDALNGTSYPITSITPAAQRLVVSPAPFVSQPQGSSCVSEGAPAGRGVQLNASLPFNVSSSNTIMLLNCTKDLLLSPLNCSSNSLCHVYANATGSTASACAPLPLCCTFVAGGSSTSYSIRVSPRFCSAYRSFVGLDPTTQPPDTWGSRLGLELQWATPREPLCRTQADCEDGANATCADDPLNTPSGASAGSVRRCFCVSGLTWSPLAGACQLNPSDCQIAGNCGGSNHAPLIAGLVCGLGSTLLVATAALFVYRRQQRIRLARERLAKEREEILNANNTSGRTAKNFSGRELKRATGNFSRDNLLGVGGYGEVYKGVLGDGTVVAVKCAKLGNTKSTDQVLNEVRVLSQVNHRSLVRLLGCCVDLEQPLMVYEFIPNGTLADHLYGSMNRPPLRWHQRLAIARQTAEGIAYLHFAASPPIYHRDIKSSNILLDDRLDGKVSDFGLSRLAEPGLSHVSTCAQGTLGYLDPEYYRNYQLTDKSDVYSFGVVLLELLTSKRAIDFGRGADDVNLAVHVQRVADEERLMDVVDPAIKEGATQLELDTMKALGFLALGCLEERRQNRPSMKEVAEEIEYIINIEAAGHPIEQQLA

SEQ ID NO: 2905 - protein, 651 aa, Zea mays
MGIALLALLLVLPASHARVCPPCGSTAVPYPLSTGDGCGDPAYKVRCAAATNSSTSSPTLMFDALNGTSYRITSISAATQRLVVAPAPLVAQGSRCVSEGRGGGVQLNASLPFNVSSSNTIMLLNCTSALLLSPLNCSSNSLCHVYANATGSTAAACAPLPLCCTFVAGGSSTSYSIRVSPQFCSAYRSFVGLDPAAQPPATWGRRLGLELQWATPREPLCRTQADCEDGANATCADDPLTPAARRCFCVPGLSWSPLAGACQLNPSDCQIAGGCGGSNHAPLIAGLVCGLGGALLLAAAGLLAYRRQRRVRLARERLAKEREEILNANNASGRTARNFSGRELKRATGNFSRDNLLGAGGYGEVYRGVLGDGTVVAVKCAKLGNTKSTDQVLNEVRVLSQVNHRSLVRLLGCCVDLDQPLMVYEFVPNGTLADHLHGATSLSRPPTLGWRQRLAIARQTAEGVAYLHSAAVPPIYHRDIKSSNILLDARLDAKVSDFGLSRLAEPGLSHVSTCAQGTLGYLDPEYYRNYQLTDKSDVYSFGVVLLELLTSKRAIDFARGADDVNLAVHVQRAADEERLMDVVDPAIKDGATQLQLDTMKALGFLALGCLEERRQNRPSMKEVAEEIEYIINIEAAGHPIEQQRTCLDSSE

SEQ ID NO: 2906 - protein, 654 aa, Oryza sativa Indica Group
MASSSLSRRALLLFFLEVAVAMALLLPGGHARVCPPCGSTEVPYPLSTADGCGDPEYKVRCAAAAAGGTAPTLLFDALNGTSYPITSISPASQRLVVSPAPFVSPGACVSVGAAASRGVQLDPSRPFNVSSSNTVMLLNCTELLLRSPLNCSSNSLCHAYAGAAGSTASACAPLPLCCTFVAGGSSTSYRIRLGPQSCSAYRSFVGLDPSQPPATWGSRLGLELQWATPREPLCRTQADCEDGAAATCADDPSATGGAGTVRRCLCVSGLVWNPIAGACQQQNLTDSGSNHAPLIAGIVCGLGGALLVATAGLFAYRRQQRIRLAKEKLAKEREEILNANNSSGRTAKNFSGRELRRATANFSRDNLLGAGGYGEVYRGVLADGTVVAVKCAKLGNTKSTEQVLNEVRVLSQVNHRSLVRLLGCCVDLEQPLMVYEFIPNGTLADHLYGPLSHPPLPWRRRLAIAHHTAQGIAYLHFSAVPPIYHRDIKSSNILLDERMDGKVSDFGLSRLAEQGLSHVSTCAQGTLGYLDPEYYRNYQLTDKSDVYSFGVVLLELLTCKRAIDFGRGADDVNLAVHVQRAAEEERLMDVVDPVLKDNATQLQCDTIKALGFLALGCLEERRQNRPSMKEVAEEIEYIMNIEAGNAHLKELHSL

SEQ ID NO: 2907 - protein, 652 aa, Hordeum vulgare subsp. vulgare
MARPFCGRLMFFSEVTAVAILAAAALLPVGCHARVCPPCGSTAVPYPLSTAAGCGDPAYKVRCAAGTSALFFDALNGTSYPITSVSPAEQRLVVSPAPLVSNDTCVSVGAAAGRGVQLDPSLPFNVSSSNTIMLLNCTSALLRSPLNCSSSSLCHAYADATASPCAPLPLCCTFVAGGSSTSHRIRASPELCSAYTSFVGLDPAQPPATWGGRLGLELQWATPREPACQTQADCEDGANATCAGDPVAAGAVRRCLCVPGLAWDPVAGACQQIPSDCERSGDCEGSNRAPIIAGIVCGLGGALLLIAAGLFLYRRQRRIRLARERLIKEREDILNANNSSGRTAKNFTARELKRATANFSRDNLLGVGGYGEVYKGALADGTLVAVKCAKLGNTKSTDQILNEVRVLSQVNHRSLVRLLGCCVDLQQPLMVYEFIPNGTLSDHLYGAMSQPPLPWRRRLAIARQTAEGISYLHFSASPPIYHRDIKSSNILLDEQLDGKVSDFGLSRLAEPGLSHVSTCAQGTLGYLDPEYYRNYQLTDKSDVYSFGVVLLELLTAKRAIDFGRGEDDVNLAVHVQRAADEERLLDVVDPAMKNRATQLELDTMKALGFLALGCLEDRRHNRPSMKEVADEIEYIINIEAGAAAVEQEQQNP

SEQ ID NO: 2908 - protein, 652 aa, Hordeum vulgare subsp. vulgare
MARPFCGRLMFFSEVTAVAILAAAALLPVGCHARVCPPCGSTAVPYPLSTAAGCGDPAYKVRCAAGTSALFFDALNGTSYPITSVSPAEQRLVVSPAPLVSNDTCVSVGAAAGRGVQLDPSLPFNVSSSNTIMLLNCTSALLRSPLNCSSSSLCHAYADATASPCAPLPLCCTFVAGGSSTSHRIRASPELCSAYTSFVGLDPAQPPATWGGRLGLELQWATPREPACQTQADCEDGANATCAGDPVAAGAVRRCLCVPGLAWDPVAGACQQIPSDCERSGDCEGSNRAPIIAGIVCGLGGALLLIAAGLFLYRRQRRIRLARERLIKEREDILNANNSSGRTAKNFTARELKRATANFSRDNLLGVGGYGEVYKGALADGTLVAVKCAKLGNTKSTDQILNEVRVLSQVNHRSLVRLLGCCVDLQQPLMVYEFIPNGTLSDHLYGAMSQPPLPWRRRLAIARQTSEGISYLHFSASPPIYHRDIKSSNILLDEQLDGKVSDFGLSRLAEPGLSHVSTCAQGTLGYLDPEYYRNYQLTDKSDVYSFGVVLLELLTAKRAIDFGRGEDDVNLAVHVQRAADEERLLDVVDPAMKNRATQLELDTMKALGFLALGCLEDRRHNRPSMKEVADEIEYIINIEAGAAAVEQEQQNP

SEQ ID NO: 2909 - protein, 652 aa, Hordeum vulgare subsp. vulgare
MARPFCGRLMFFSEVTAVAILAAAALLPVGCHARVCPPCGSTAVPYPLSTAAGCGDPAYKVRCAAGTSALFFDALNGTSYPITSVSPAEQRLVVSPAPLVSNDTCVSVGAAAGRGVQLDPSLPFNVSSSNTIMLLNCTSALLRSPLNCSSSSLCHAYADATASPCAPLPLCCTFVAGGSSTSHRIRASPELCSAYTSFVGLDPAQPPATWGGRLGLELQWATPREPACQTQADCEDSANATCAGDPVAAGAVRRCLCVPGLAWDPVAGACQQIPSDCERSGDCEGSNRAPIIAGIVCGLGGALLLIAAGLFLYRRQRRIRLARERLIKEREDILNANNSSGRTAKNFTARELKRATANFSRDNLLGVGGYGEVYKGALADGTLVAVKCAKLGNTKSTDQILNEVRVLSQVNHRSLVRLLGCCVDLQQPLMVYEFIPNGTLSDHLYGAMSQPPLPWRRRLAIARQTAEGISYLHFSASPPIYHRDIKSSNILLDEQLDGKVSDFGLSRLAEPGLSHVSTCAQGTLGYLDPEYYRNYQLTDKSDVYSFGVVLLELLTAKRAIDFGRGEDDVNLAVHVQRAADEERLLDVVDPAMKNRATQLELDTMKALGFLALGCLEDRRHNRPSMKEVADEIEYIINIEAGAAAVEQEQQNP

SEQ ID NO: 2910 - protein, 640 aa, Oryza sativa Japonica Group
MASSSLSRRALLLFFLEVAVAMALLLPGGHARVCPPCGSTEVPYPLSTADGCGDPEYKVRCAAAAAGGTAPTLLFDALNGTSYPITSISPASQRLVVSPAPFVSPGACVSVGAAASRGVQLDPSRPFNVSSSNTVMLLNCTELLLRSPLNCSSNSLCHAYAGAAGSTASACAPLPLCCTFVAGGSSTSYRIRLGPQSCSAYRSFVGLDPSQPPATWGSRLGLELQWATPREPLCRTQADCEDGAAATCADDPSATGGAGTVRRCLCVSGLVWNPIAGACQQQRIVCGLGGALLVATAGLFAYRRQQRIRLAKEKLAKEREEILNANNSSGRTAKNFSGRELRRATANFSRDNLLGAGGYGEVYRGVLADGTVVAVKCAKLGNTKSTEQVLNEVRVLSQVNHRSLVRLLGCCVDLEQPLMVYEFIPNGTLADHLYGPLSHPPLPWRRRLAIAHHTAQGIAYLHFSAVPPIYHRDIKSSNILLDERMDGKVSDFGLSRLAEQGLSHVSTCAQGTLGYLDPEYYRNYQLTDKSDVYSFGVVLLELLTCKRAIDFGRGADDVNLAVHVQRAAEEERLMDVVDPVLKDNATQLQCDTIKALGFLALGCLEERRQNRPSMKEVAEEIEYIMNIEAGNAHLKELHSL

SEQ ID NO: 2911 - protein, 376 aa, Zea mays
MHSYRAMHPYTHHSYQHHTAAVAPTKHGHGHGHGHGHGDEEDDQSMLLLSLWPPGHHHGNAAASSACSSPPICASATTTSMAAAASSPASYPWLTHQSLYNNAGCGGGSSSSSHSSFLFQEHQQEPGVSISLSIAPPCSNNAASSCGGGGFAAPPAAPSTVTTTVTPGGGQVPRQYWIPSAAEILVGSTQFSCAVCNKTFNRFNNMQMHMWGHGSQYRKGSESLRGAITVGTAPPASLMRLPCYCCAEGCRNNIEHPRARPLKDFRTLQTHYRRKHGARPYACRRCGKRFAVRGDWRTHEKNCGKLWFCVCGSDFKHKRSLKDHVRSFGGGHAPHLVESVAVEDEEEEDDDHDDDDLQTFDDNGGAGADPSDMVVI

SEQ ID NO: 2912 - protein, 370 aa, Sorghum bicolor
MHSYRAMHPYTHPYQHHTAAVAPTKHGHGHGEEEDDQSMLLLSLWPPGQHHGIAAASSACSSPPICATTTTTTSMAAAASYPWLTTHQSHYNGGCGGGSSSSSHSSFLFHEHQQQEPDVSISLSIAPPCSNTAASCGAAAGGFAAPAAPSTVTTVTPGGSQVPSQYWIPSAAEILVGSTQFSCAVCNKTFNRFNNMQMHMWGHGSQYRKGSESLRGAITVGTAPPASLMRLPCYCCAEGCRNNIEHPRARPLKDFRTLQTHYRRKHGARPYACRRCGKRFAVRGDWRTHEKNCGKLWFCVCGSDFKHKRSLKDHVRSFGGGHAPHIVESVAVEDDEEDDDDHDDADLHAFDDNVGNGGGAGGEPSDMVVV

SEQ ID NO: 2913 - protein, 374 aa, Zea mays
MHSYYRAMHPYAHPYQHHAAAVAPTTKHGHCHDAEEEDDHQSMLLLSLWPPGHHHHSVAAAASSACSSPPTICATTSTTSMAASAASSYPCCLTHQSHYNGGGSAGSSSHSSCFLFHHEHQQQQEPDVSISLSIAPPRSNNDAASCGGRGFAAPSTVTTPEVPTSQYWIPSASEILVGSTQFSCAVCNKTFNRFNNMQMHMWGHGSQYRKGSESLLRGAIITVGTAAAASSSLTRLPCYCCAEGCRNNIEHPRARPLKDFRTLQTHYRRKHGARPYACRRCGKRFAVRGDWRTHEKNCGRLWFCACGSDFKHKRSLKDHVRSFGGGHAPRVVESVAVEDEEEEEDVDDADDDGDLQTFDDNGASGERPSDMVVV

SEQ ID NO: 2914 - protein, 355 aa, Hordeum vulgare subsp. vulgare
MHSYRAMHPHPHPYHTAPAPPTKMASGGHGGATEDDDQSMLLLSLWPPGHHHDAAASSSACSSHSVATAAHSTASSPWFNPSHVYNGCGVGGGGGSGSGGFLFHEQGRNVSVSLSIAPPSPCGANLAPSGGSFAAPLAPPSAASAGGNQVPSQYWIPSAAEILVGSTQFSCAVCNKTFNRFNNMQMHMWGHGSQYRKGSESLRGAVTVGTAAPPPSLLRLPCYCCAEGCRNNIDHPRARPLKDFRTLQTHYRRKHGARPYACRRCGKRFAVRGDWRTHEKNCGKLWFCVCGSDFKHKRSLKDHVRSFGGGHAPHIVESVAVDEDEDEDDEHDDGDQLHLYDENGNAGDGSDMVLL

SEQ ID NO: 2915 - protein, 199 aa, Zea mays
MSLLGSLPSAMATSTTFSCRCFSSGARPCVGHAPGCRVPASCALAPNPTRPPCSDRVLGSSSALSCAGVLYSIFFPSAPWYSLAAARALPCLLVVDAGRCPCRAPFSSPASRALRGRRSQPSTHRAPCRCAPSRLHSDRALAAGARRPRLSCTLLRSSRSPLSSPCVRSHVPLLAVLAVYVIAGLVSPTIVMLLFPAAP

SEQ ID NO: 2916 - protein, 374 aa, Zea mays; identical to SEQ ID NO: 2913

SEQ ID NO: 2917 - protein, 370 aa, Sorghum bicolor; identical to SEQ ID NO: 2912

SEQ ID NO: 2918 - protein, 376 aa, Zea mays; identical to SEQ ID NO: 2911

SEQ ID NO: 2919 - protein, 155 aa, Zea mays
MCPARPWRQPQLGAPSASPGLRLLLAPAWSSLDLQLRRPAELPGCRALLSFAAHRCSSSRRPCFSLSSSTPAMARVSAPSPTACPSSSSRPRPRRGPSSPALLPAQLSSARPISLRSAPSSVFLGRARSGRGHRRAQGPARRMSTHHAWSNGGNL

SEQ ID NO: 2920 - protein, 343 aa, Sorghum bicolor
MAQRKVAMAAAAFFALLAVASLLCAPAAAGLVRMEHPAKNDGSLSLLVVGDWGRKGTYNQSRVAYQMGKVGEQLNIDFVISTGDNFYENGLTGTDDQGFEQSFTDIYTAKSLQKPWYLVLGNHDYRGDALAQLSPVLRKIDSRFICMKSFIVNAEIVDFFFVDTTPFQLKYWTHPKDDHYDWRGVAPREKYINILLKDLDEAMKKSTAAWKIAVGHHTMRSVSDHGDTKELLQLLLPVLQANGVDFYINGHDHCLEHISSRDSPIQYFTSGGGSKAWRGVQNTNEDDLKFFYDGQGFMSLQLDHSEAHFTFYDVDGEALYHYTRPSLRKTAGHLQASGYVNEE

SEQ ID NO: 2921 - protein, 348 aa, Zea mays
MAQGSRSATVPAAASFFALVAVAPLLLCCAPAAAELARLEHPAKDGGSLSLLVVGDWGRKGTFNQSRVAHQMGRVGEQLSIDFVISTGDNFYENGLTGTDDEAFEQSFTDIYTAKSLQKPWYLVLGNHDYRGDALAQLSPVLRKIDSRFICIKSFVVNAEIVEFFFVDTTPFQLKYWTHPKDDHYDWRGVAPRENYINNLLKDLDGAMKTSTAAWKVAVGHHTMRSVSDHGDTKELLQLLLPVLQANGVDFYINGHDHCLEHISSRDSPIQYFTSGGGSKAWRGVQNPTEDDLKFFYDGQGFMSLQLDRSQAKFTFYDVDGKALYSYTRSSLMETGHHLQASGYVNEE

SEQ ID NO: 2922 - protein, 349 aa, Zea mays
MAQGSRSAAVPAAASFFALLAVAAPLLLCCAPAAAELARLEHPPKDGGSLSLLVVGDWGRKGTFNQSRVAHQMGRVGEQLSIDFVISTGDNFYENGLTGTDDEAFEQSFTDIYTAKSLQKPWYLVLGNHDYRGDALAQLSPVLRKIDSRFICIKSFVVNAEIVEFFFVDTTPFQLKYWTHPKDDHYDWRGVAPRENYINNLLKDLDGAMKTSTAAWKVAVGHHTMRSVSDHGDTKELLQLLLPVLQANGVDFYINGHDHCLEHISSRDSPIQYFTSGGGSKAWRGVQNPTEDDLKFFYDGQGFMSLQLDRSQAKFTFYDVDGKALYSYTRSSLMETGHHLQASGYVNEE

SEQ ID NO: 2923 - protein, 339 aa, Oryza sativa Japonica Group
MARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEA

SEQ ID NO: 2924 - protein, 334 aa, Zea mays
MANRSVAMGVALAFVAMTALCCAPGAAELPRLDHPARSDGSLKLLVVGDWGRKGTHNQSRVADQMGRVGEKLDIDFVISTGDNFYKDGLKGVRDQAFEESFVDIYTAQSLQKPWYSVLGNHDYRGNALAQLSPVLRKIDDRFICMRSFIVNAELVDFFFVDTTPFQLEYWTHPGKDRYDWRGVAPRGKYIANLLKDLDVAMKKSTARWKIVAGHHTMRSVSEHGDTKELLELLLPVLKDNGVDFYINGHDHCLEHISSRDSPLQYFTSGGGSKAWRGVFHPNKDKLRFFYDGQGFMSLQLNQDQAHFIFYDVFGNILYRWSSRHPQPSTYLDEE

SEQ ID NO: 2925 - protein, 334 aa, Zea mays
MANRSVAMGLALAFVAMTALCCAPGAAELPRLDHPARSDGSLKLLVVGDWGRKGTHNQSRVADQMGRVGEKLDIDFVISTGDNFYKNGLKGVRDQAFEESFVDIYTAQSLQKPWYSVLGNHDYRGNALAQLSPVLRKIDDRFICMRSFIVNAELVDFFFVDTTPFQLEYWTHPGKHRYDWRGVAPRGNYLANLLKDLDVAMKKSTARWKIVVGHHTMRSVSEHRDTEELLELLLPVLKDNGVDFYINGHDHCLEHISSRDSPLQYFTSGGGSKAWRGVFHPNKDKLRFFYDGQGFMSLQLNQDQAHFIFYDVFGNILYRWSSRHPQSSTYLDEE

SEQ ID NO: 2926 - protein, 277 aa, Zea mays
MGRVGEQLSIDFVISTGDNFYENGLTGTDDEAFEQSFTDIYTAKSLQKPWYLVLGNHDYRGDALAQLSPVLRKIDSRFICIKSFVVNAEIVEFFFVDTTPFQLKYWTHPKDDHYDWRGVAPRENYINNLLKDLDGAMKTSTAAWKVAVGHHTMRSVSDHGDTKELLQLLLPVLQANGVDFYINGHDHCLEHISSRDSPIQYFTSGGGSKAWRGVQNPTEDDLKFFYDGQGFMSLQLDRSQAKFTFYDVDGKALYSYTRSSLMETGHHLQASGYVNEE

SEQ ID NO: 2927 - protein, 334 aa, Zea mays
MANRSVAMGLALAFVAMTALCCAPGAAELPRLDHPARSDGSLKLLVVGDWGRKGTHNQSRVADQMGRVGEKLDIDFVISTGDNFYKNGLKGVRDQAFEESFVDIYTAQSSQKPWYSVLGNHDYRGNALAQLSPVLRKIDDRFICMRSFIVNAELVDFFFVDTTPFQLEYWTHPGKHRYDWRGVAPRGNYLANLLKDLDVAMKKSTARWKIVVGHHTMRSVSEHRDTEELLELLLPVLKDNGVDFYINGHDHCLEHISSRDSPLQYFTSGGGSKAWRGVFHPNKDKLRFFYDGQGFMSLQLNQDQAHFIFYDVFGNILYRWSSRHPQSSTYLDEE

SEQ ID NO: 2928 - protein, 335 aa, Triticum aestivum
MARGSMAAVLAVLAVAALRCAPAAAELPLVEHPAKNDGSLSLLVVGDWGRNGTYNQSRVAEQMGKVGERLDIDFVVSTGDNFYENGLTGVHDQQFEESFTNIYTAQSLQKPWYLVLGNHDYRGDALAQLDPVMRKLDERFVCMRSFLVNAEIVEFFFIDTTPFQLKYWTHPKDSHYDWRGVAPRKDYIANLLKDLDEAMKKSTAKWKIAIGHHTMRSVSDHGDTEELLQLLLPVLKVNGIDFYINGHDHCLEHISSRDSPIQYFTSGGGSKAWRGVYQPNDDKIQFFYDGQGFMSLQLNQDQADFIFYDVSGKVLYEFTSHKTNHFQPSIYVTAE

SEQ ID NO: 2929 - protein, 337 aa, Hordeum vulgare subsp. vulgare
MARRSGAGASAAVALAVLAVAALRCAAELPLVEHPAKNDGSLSLLVIGDWGRKGTFNQSMVADQMGKVGEKLDIDFVVSTGDNFYEDGLTGVHDRQFEESFTSIYTAKSLQKPWYLVLGNHDYRGDALAQLDPVMRKLDERFVCMRSFVVNAEIVEFFFIDTTPFQLKYWTHPKDSHYDWRGVAPRKNYIANLLKDLDEAMKKSTAKWKIAVGHHTMRSVSDHGDTEELLQLLLPVLKVNGIDFYINGHDHCLEHISSRNSPIQYFTSGGGSKAWRGVYQPNDDKLQFFYDGQGFMSLQLNKDQADFIFYDVSGKVLYEWTSRKTNHFQPSIYVTAE

SEQ ID NO: 2930 - protein, 1045 aa, Sorghum bicolor; identical to SEQ ID NO: 2882

SEQ ID NO: 2931 - protein, 1045 aa, Zea mays; identical to SEQ ID NO: 2881

SEQ ID NO: 2932 - protein, 1068 aa, Oryza sativa Japonica Group; identical to SEQ ID NO: 2883

SEQ ID NO: 2933 - protein, 1051 aa, Oryza sativa Japonica Group; identical to SEQ ID NO: 2884

SEQ ID NO: 2934 - protein, 1085 aa, Hordeum vulgare subsp. vulgare; identical to SEQ ID NO: 2885

SEQ ID NO: 2935 - protein, 848 aa, Sorghum bicolor
MADFGGGDSELEEQSNEGYQEPAFEAFMCPLTKQVMHDPVTIETGQTFEREAILKWFRECRDSGRKPTCPLTQAELRSTDISPSIALRNVIDEWRARNEDKELDKAFASLSLTTTQHAQDDADTLRALLYVSQMCHRSAAKKTLVRRQGVIPTITDLLKSSSRRVRLKALEVLRLIVEDNDENKEELGKGDTIRTIIKFLSNENFQERELAVSLLYELSKLDPICERIGAIYGAILLLVGMASSKSENGVAVEKAENTLKNLDKYETNVKQMAENGRLQPLLTKLIQGTPQVQVAMAEYLGELALANDVKVVVAEQVGALLVSILKTGSLPAREATLKALREISSNESSAKILLQAGILPPLVKDLFSLGAGHLPMRLKEVSAAILANLVASGASFRSIPLDESGETLLSEEMVHSLLHLISNTGPAIECKLLNVLVGLTGSPSTVADVVSAIRSSGATISLIQFVEAAHREIRVESLKLLRNVSPYMGAELADALGLGGSTGHLGSLLGVITVTEDHRSGVTEEQAAAVALLGDLPERDWNLTRQLQELGAFRALATKLVELRRGTIRGNRHVAPFTEGAVKVLYRVTCALQLQLQEEEAAEVYVELAREVGLAPLFVELLQQQMSSGQDAVLLYSAMALENLSLQSARLTDVPEPPPPPGSLLMCGCFGGPRHRHGHGKQPQPQLPGAMGTCRVHGGFCSLRETFCLAESGCKAVERLVACLEHADDRVVEAALAALSTLVGDGVANATEGVLVVGEAEGLRPVVEVLVENRTEALQRRAVWAVERILRVEDIALEVAADQTVASALVEAYRNGDVRTRQTAERALRHLDRIPNFSSAFHQAKGRA

SEQ ID NO: 2936 - protein, 825 aa, Zea mays
MEGFCGGDSELDEQSNQEPAFEAFMCPLTKQVMHDPVTIETGQTFEREAILKWFRECRDSGRKPTCPLTQAELRSTDITPSIALRNVIQEWRARNEDKELDKAMASLTATQEAQAQDDDDDTLRALLYVSRMKKTLVRRQGVIPTIADLLKSSSRRVRLKALQVLGVIVEEDDENKEELAKGDTIRTIIKFLSNENFQERELAVSLLYELSKFDPTCERIGAIYGAILLLVGMASSKSEHGVAVEKAENTLKNLEKYETNVKQMAENGRLQPLLTKLIQGPPQVQLAMAEFLGELALANDVKVLVAEQVGALLVTIMKTEGSLPAREATLKALREISSNESSARILLQAGILPPLVKDLFSLGAGHLPMRLKEVSAAILANLVASGASFRSIPLDHSGETLLSEEMVHSLLHLISNTGPAIECKLLNVLVGLTASPATVPDVVSAIRSSGATISLIQFVEAAHREIRVESLKLLRNVSPYMGAELADALGLGGSTGNLSSLLGVATVTEDRSGVTEEQAAAVALLGDLPERDWNLTRQLQELGAFRALATKLVELRRGTIRGNRHVAPFTEGAVKVLYRVTCALALLQQEETYVELAREVGLAPLFVELLQQMMSSGQEAVLLYSAMALENLSLQSSRLTDVPAPRRGSSLVCGCFGQGRSPPPPGAMGTCRVHGGFCSLRETFCLAEGGCKAVERLVACLEHADPRVVEAALAALSTLLGDGVANATEGVLVIGEAEGLRPVVEVLVENRTEALQRRAVWAVERILRVEDIALEVAADQTVASVLVEAYRNGDVRTRQTAERALRHLDRIPNFSSAFHQAKGRA

SEQ ID NO: 2937 - protein, 823 aa, Hordeum vulgare subsp. vulgare
MMARNSDGELEEQSTEGYQEAAFEAFMCPLTKQVMQDPVTIETGQTFEREAILKWFRECRDNGRRPTCPLTQRELRTTDINPSIALRNVIDEWRARNDEKDLDKACNALRLHPEDDEDDTLRAMAYISQICQRSGAKKNLVRAQGIISTLADLLKSSSRRVRLKSLQVLRTVVEDNDQNKEELGKGDTVRTIIKFLSNENIQERELAVSLLYELSEYEPVCERIGAVYGAILLLVGMGSSKSENMMAVEKAEKTLKNLEKYDTNIKQMAENGRLQPLLTKLLQGGPEVQVTMVEYLGELALANDVKVVVAEQVGTLLVSIIKTGGLPAREATLKAMREMSSNELSAKILLQAGILPPLVKDLFSVGASSHFPMRLKEVSATILANLVASGASFRSIPLDDAGRQTLLSEDVVHSLLHLISNTGPAVECKLLNVLVGLTSSPDTAQDVVSAIKSSGATISLIQFLEAAHREIRVESLKLLRNVSPYMGAELADALGGHLSSLLRVISDPGAGGVTEEQAAAVGLLGDLPERDSKLTRQLFELGAFGTLSTKLAELRRGAIRGNRYTTPLTEGMVKVMYRLTCMLQEAPEYVEFAREAALAPLFVELVQVNGQDAVQLYSALALEKLSLETRNLTVIPDPPPPAPSGFLCACFGVPSSTGAAAGRPVGVCRVHGGFCSLRESFCLAEGGAGGKAVERLVACLDHLNPEVVEAALAALATLVGDGVEAAEGVGVLGDADGLRPVVDILVENRTEALRRRAVWVVERILRVEDIAQEVAADQTVASALVEAYRNGDPRTRHTAERALRHLDRIPNFSSAFHAQARRP

SEQ ID NO: 2938 - protein, 824 aa, Oryza sativa Japonica Group
MAGEGVEMSEEEGAFEAFVCPLTKQVMRDPVTIETGQTFEREAILKWFRECRDNGRRPTCPLTQRELRDTEVSPSVALRSVIHEWRARNEEKDLDRACASLVGGFAGHAGDEEEEESALRALVHVSQICQRSAASKDLVRRRGVLRAVAEMLKSGSRRLRLKSLQVLRVLVEDNDDNKEELGKGDTIRTIIKFLSNEHVQERELAVSLLHELSGHEPTCERIGAVYGAILLLVGMGSSKSESAVAVDKAESTLRNLDRFDANVKQMADNGRLQPLLTRLLRGEPDTRVAMADYLGELALANDDKAAVAEQAGPLLVGMLRTGATPAKEATLKALREISSSEASAKLLLQRAGVLPPLVNDVLFSTGHLPMKLKELAATILANLVASGADFRSIPLDDDEDDDGGGGGRGRRRTLLSEDVVHSQLHLISNTGPAIGCRLLSVLAGLTSSRATVADVVAAVKSSGATISLIQFIEAAHRDIRVESLKLLRNLAPYMGAELADALGGSLSSLLRAISSDGGGVTEEQAAAVGLLGDLPEGDSSLTRQLFDLGAFRALAPKLAELRRGTIRGGNRYVTPLTEGVVKVMYRVTCALEEDAEYVEFAREAGLAPLFVELLHTNGMDTVQLYSAMALEKLSLQSSHLTAIPAPPSPPAGFGCACLGRRPAAAAVPAGVCRVHGGFCSLRETFCLAQADGGKAVERLVACLDHLDGRVVEAALAALSTLVCDGVDAREGVVVLGEADGLRPVVDIMVESRTEALQRRAVWAVERILRVEEIAGEVAADQTVASALVEAYRNGDPRTRQTAERALRHLDRIPNFSAAFQSKRS

SEQ ID NO: 2939 - protein, 852 aa, Oryza sativa Japonica Group
MAGEGVEMSEEEGAFEAFVCPLTKQVMRDPVTIETGQTFEREAILKWFRECRDNGRRPTCPLTQRELRDTEVSPSVALRSVIHEWRARNEEKDLDRACASLVGGFAGHAGDEEEEESALRALVHVSQICQRSAASKDLVRRRGVLRAVAEMLKSGSRRLRLKSLQVLRVLVEDNDDNKVANPIHPPNFNLPPNQARIDRFLVLILQEELGKGDTIRTIIKFLSNEHVQERELAVSLLHELSGHEPTCERIGAVYGAILLLVGMGSSKSESAVAVDKAESTLRNLDRFDANVKQMADNGRLQPLLTRLLRGEPDTRVAMADYLGELALANDDKAAVAEQAGPLLVGMLRTGATPAKEATLKALREISSSEASAKLLLQRAGVLPPLVNDVLFSTGHLPMKLKELAATILANLVASGADFRSIPLDDDEDDDGGGGGRGRRRTLLSEDVVHSQLHLISNTGPAIGCRLLSVLAGLTSSRATVADVVAAVKSSGATISLIQFIEAAHRDIRVESLKLLRNLAPYMGAELADALGGSLSSLLRAISSDGGGVTEEQAAAVGLLGDLPEGDSSLTRQLFDLGAFRALAPKLAELRRGTIRGGNRYVTPLTEGVVKVMYRVTCALEEDAEYVEFAREAGLAPLFVELLHTNGMDTVQLYSAMALEKLSLQSSHLTAIPAPPSPPAGFGCACLGRRPAAAAVPAGVCRVHGGFCSLRETFCLAQADGGKAVERLVACLDHLDGRVVEAALAALSTLVCDGVDAREGVVVLGEADGLRPVVDIMVESRTEALQRRAVWAVERILRVEEIAGEVAADQTVASALVEAYRNGDPRTRQTAERALRHLDRIPNFSAAFQSKRS

SEQ ID NO: 2940 - protein, 266 aa, Zea mays
MWNCSSLLLQYGDDYAARCESSSSPAGAVGLDRILAAEYGRFDSLDLSPPPPLHGLQAQTLFAIHGSSENCLGIGANPIYSTEARPAFSQLSFTQPAADTAAHYSMKWTAAGETATGGGGSRLRGSKRLKTKTPATAQGPQHHGQRCSPKPTTSQSIKAPPCKRSQKLGDKITALQQLVSPYGKTDTASVLHEAATCIKHLHEQIQFSSVTAGHGRRRGRRDGSAPARPVRGVAVPGRRAARVGRGRARQPRHGRPLALARHSVSL

SEQ ID NO: 2941 - protein, 921 aa, Zea mays; identical to SEQ ID NO: 2891

SEQ ID NO: 2942 - protein, 916 aa, Zea mays; identical to SEQ ID NO: 2890

SEQ ID NO: 2943 - protein, 924 aa, Sorghum bicolor; identical to SEQ ID NO: 2887

SEQ ID NO: 2944 - protein, 920 aa, Sorghum bicolor; identical to SEQ ID NO: 2886

SEQ ID NO: 2945 - protein, 941 aa, Zea mays; identical to SEQ ID NO: 2889

SEQ ID NO: 2946 - protein, 918 aa, Zea mays; identical to SEQ ID NO: 2888

SEQ ID NO: 2947 - protein, 899 aa, Oryza sativa Japonica Group; identical to SEQ ID NO: 2892

SEQ ID NO: 2948 - protein, 911 aa, Hordeum vulgare subsp. vulgare; identical to SEQ ID NO: 2894

SEQ ID NO: 2949 - protein, 911 aa, Hordeum vulgare subsp. vulgare; identical to SEQ ID NO: 2893

SEQ ID NO: 2950 - protein, 911 aa, Hordeum vulgare subsp. vulgare; identical to SEQ ID NO: 2895

SEQ ID NO: 2951 - protein, 250 aa, Sorghum bicolor
MYEFNFSLPPDYALVIRALGSLEGTAKALDPEFKVIESAYPFVIGRLLADPSPDMRKILRELLIRDDGSIRWNRLERLIAAISEQSSESSSTVGADSSENANGSPEWRSFDMHSVIAATEDLFDFILSRKGWRVRVFLVQDIVKASDVFLQEATFPYIFDNVGKIGDINPERSKMIRRLVNTVQSFRQAISLAPDAWSAMLIRTLLKHEAQKFVLDVFLTLASHSSYKIPETFWLCMSRFLNYLDKQDTF

SEQ ID NO: 2952 - protein, 381 aa, Sorghum bicolor
MGCFSCCCVADDDDIGRRKKHDDAYVPIPAQVDNFGPSRPPAPIPVIPTGRDQPIAVPPIHLEELKEITKNFSSDALIGEGSYARVYFGVLKDGTKSAVKKLDSSKQPDQEFLVQVSAVSRLKHENVVQLVGYCAEGITRVLAYEYATRGSLHDILHGKKGVKGAQPGPVLSWMQRARIAVSAARGLEFLHEKADSRVVHRDIKSSNILLFDNDVAKIGDFDISNQSPDMAARLHSTRVLGTFGYHAPEYAMTGQLSTKSDVYSFGVVLLELLTGRKPVDHTLPRGQQSLVTWATPRLSEDKVKQCVDPRLGDEYPPKAVAKMAAVAALCVQYEGEFRPNMSIVVKALSPLLHSRPGNRPAASPASPAAAAAAAAAERSGL

SEQ ID NO: 2953 - protein, 374 aa, Zea mays
MGCFSCCCVADDDNVGRRKKHDDPYVPIPAHVYNFGPSRFPAPTPVISTGRAQPIAVPAIHLEELKEITKNFSSDALIGEGSYARVYFGVLKDGTKSAVKKLDSSKQPDQEFLVQVSAVSRLKHENVVQLVGYCAEGSTRVLAYEYATRGSLHDILHGKKGVKGAQPGPVLSWMQRARIAVCAARGLEFLHEKADPRVVHRDIKSSNILLFDHDVAKIGDFDISNQAPDMAARLHSTRVLGTFGYHAPEYAMTGQLSTKSDVYSFGVVLLELLTGRKPVDHTLPRGQQSLVTWATPRLSEDKVRQCVDPRLGDEYPPKAVAKMAAVAALCVQYEGEFRPNMSIVVKALNPLLHSRSGNRPTASSASHAAERSGL

SEQ ID NO: 2954 - protein, 374 aa, Zea mays
MGCFSCCCVADDDNVGRRKKHDDPYVPIPAHVYNFGPSRFPAPTPVISIGRAQPIAVPAIHLEELKEITKNFSSDALIGEGSYARVYFGVLKDGTKSAVKKLDSSKQPDQEFLVQVSAVSRLKHENVVQLVGYCAEGSTRVLAYEYATRGSLHDILHGKKGVKGAQPGPVLSWMQRARIAVCAARGLEFLHEKADPRVVHRDIKSSNILLFDHDVAKIGDFDISNQAPDMAARLHSTRVLGTFGYHAPEYAMTGQLSTKSDVYSFGVVLLELLTGRKPVDHTLPRGQQSLVTWATPRLSEDKVRQCVDPRLGDEYPPKAVAKMAAVAALCVQYEGEFRPNMSIVVKALNPLLHSRSGNRPTASSASHAAERSGL

SEQ ID NO: 2955 - protein, 374 aa, Zea mays
MGCFSCCCVADDDNVGRRKKHDDPYVPIPAHVYNFGPSRFPAPTPVISTGRAQPIAVPAIHLEELKEITKNFSSDALIGEGSYARVYFGVLKDGTKSAMKKLDSSKQPDQEFLVQVSAVSRLKHENAVQLVGYCAGGSTRVLAYEYATRGSLHDILHGKKGVKGAQPGPVLSWMQRARIAVCAARGLEFLHEKADPRVVHRDIKSSNILLFDHDVAKIGDFDISNQAPDMAARLHSTRVLGTFGYHAPEYAMTGQLSTKSDVYSFGVVLLELLTGRKPVDHTLPRGQQSLVTWATPRLSEDKVRQCVDPRLGDEYPPKAVAKMAAVAALCVQYEGEFRPNMSIVVKALNPLLHSRSGNRPTASSASHAAERSGL

SEQ ID NO: 2956 - protein, 377 aa, Zea mays
MGCFSCCCVADDDNVGRRKKHDDPYVPIPAHVYNFGPSRFPAPTPVISTGRAQPIAVPAIHLEELKEITKNFSSDALIGEGSYARVYFGVLKDGTKSAVKKLDSSKQPDQEFLVQVSAVSRLKHENVVQLVGYCAEGSTRVLAYEYATRGSLHDILHGKKGVKGAQPGPVLSWMQRARIAVCAARGLEFLHEKADPRVVHRDIKSSNILLFDHDVAKIGDLDISNQAPDMAARLHSTRVLGTFGYHAPEYAMTGQLSTKSDVYSFGVVLLELLTGRKPVDHTLPRGQQSLVTWATPRLSEDKVRQCVDPRVGDEYPPKAVAKMAAVAALCVQYEGEFRPNMSIVVKALNPLLHSRSGNRPTASSASHAAAAAERSGL

SEQ ID NO: 2957 - protein, 371 aa, Oryza sativa Indica Group
MGCFSCCGADDVGKKKKRDDPYVPIPDPGSNYGRSKPGPPAPSRSPPTSRNLPIAVPAIPLDEIKGITKNFSSDALIGEGSYARVFFGVLRDGRRSAVKKLDSSKQPDQEFLVQVSAVSRLKHENIIQLIGYCAGGSIRVLAYEYAPRGSLHDILHGKKGVKGAQPGPALSWMQRVKIALSAAKGLEFLHEKAEPRVVHRDIKSSNIMLFDNDVAKVGDFDVSNQSPDMAARLHSTRVLGTFGYHAPEYAMTGQLSTKSDVYSFGVVLLELLTGRKPVDHTLPRGQQSLVTWATPRLSEDKVKQCVDPRLEGDYPPKAVAKMAAVAALCVQYEADFRPNMSIVVKALNPLLNSRPNNRPASFTDAGERSGL

SEQ ID NO: 2958 - protein, 371 aa, Oryza sativa Japonica Group
MGCFSCCGADDVGKKKKRDDPYVPIPDPGGNYGRSKPGPPAPSRSPPTSRNLPIAVPAIPLDEIKGITKNFSSDALIGEGSYARVFFGVLRDGRRSAVKKLDSSKQPDQEFLVQVSAVSRLKHENIIQLIGYCAGGSIRVLAYEYAPRGSLHDILHGKKGVKGAQPGPALSWMQRVKIALSAAKGLEFLHEKAEPRVVHRDIKSSNIMLFDNDVAKVGDFDVSNQSPDMAARLHSTRVLGTFGYHAPEYAMTGQLSTKSDVYSFGVVLLELLTGRKPVDHTLPRGQQSLVTWATPRLSEDKVKQCVDPRLEGDYPPKAVAKMAAVAALCVQYEADFRPNMSIVVKALNPLLNSRPNNRPASFTDAGERSGL

SEQ ID NO: 2959 - protein, 291 aa, Sorghum bicolor
MDPPQESAAAGRKRRRRGGVRNRKKLSSQKGLPPAAAPPTPASPPVKRRRKDVAGQAAAMPKRGNTSSLLDKMRARLSGGHFRMLNEKLYTCSGEDAFDYFKNDPNLFDVYHTGYQEQMSHWPEQPVNVIINWLKSHNASWTVADFGCGNATVAKNVKNKVFSIDLVSDDPSVIACDMAHTPLEPSSIDVAIFCLSLMGINYPSYLEEANRVLKPSGWLVIAEVRSRLDPNNGGADPEKFSKAIIELGFSLVSKDVKNKMFILFYFRKKEKSKLAKSIDWPQLKPCLYKRR

SEQ ID NO: 2960 - protein, 291 aa, Zea mays
MDPPQELAAAGRKRRRRGGVRNRKRLSSQKGLPPATAPPTPASPPVKRRRKDIAGQAAAMPKRGNTSSLLDKMRARLSGGHFRMLNEKLYTCSGEDAFDYFKNDPNLFDVYHTGYQEQMSHWPEQPVNVIINWLKSQNASWTVADFGCGNAAVAKNLKNKVFSIDLVSDEPSVIACDMAHTPLEPSSIDVAIFCLSLMGINYPSYLEEANRVLKPSGWLVIAEVRSRLDPSNGGADPEKFSKAIIQLGFSLVSKDVKNRMFILFYFRKKEKSKVAKSIDWPQLKPCLYKRR

SEQ ID NO: 2961 - protein, 292 aa, Oryza sativa Japonica Group
MEPLQEAAAAAAGGRKRRRRGGGRNRRKHQASSSSGAAASASPPSPPAKRQRGDDAAPKGRGSKPKPASLLDKMRARLSGGHFRMLNEKLYTCSGQDAFDYFTNEPDLFDVYHAGYREQMSHWPEQPVNVIINWLKSHSASWTVADFGCGNAAVSKNVKNKVFSIDLVSEDPSVIACDMAHTPLESSSVDVAIFCLSLMGTNYPSYIEEANRVLKPSGWLLIAEVRSRLDPNTAGADPDKFCEAISKLGFSLVSKDAKNKMFILFHFRKKEKSKVVKNIDWPQLKPCLYKRR

SEQ ID NO: 2962 - protein, 890 aa, Sorghum bicolor
MRKLFFSESACKETKLHSAPHSWLPLERGKLSKFSGHAAASSSIDSLMKMPEPAVLPHFKPADYVDILAQIHEELESCSPDEKSCLYLLQFQVFRGLGEAKLSRRSLQSAWEKASTIHEKLIFGAWLKYEKKGEEAIADLLSSCGKCSQEFRLLDFVSQVSTGSHVMSYDDDDDESDEFQGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFVSSRQDAIDFMECALELGCSILAASCLQVLLNELPECLNDEQVVRIFSSANKAQRLTMVGNASFSLYCLLSEVSMSTNPTSDVTVSFLEKLVESASDSRQKQLALHQLACTRFLRKDYPESERLFNAAFSAGHLYSLVGLARLAALRGNKHFALKFLDSVMSSRWPLGWMYQERALYLEGDNKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTAADCWMQLYDRWSSVDDIGSLSVIYQMLESDNAKGVLYFRQSLLLLRLNCPEAAMRSLQLAREHASSDHERLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNNRAGAYDEMTKLIEKARNNASAYEKRSEYCDRELTKTDLQMVTKLDPLRVYPYRYRAAVLMDNHKEKEAIAELTKAIAFKADLNLLHLRAAFHEHIGDISSALRDCRAALSVDPNHQEMLELHHRVNSQEP

SEQ ID NO: 2963 - protein, 886 aa, Oryza sativa Japonica Group
MRKLFFSELTSCKETKLHSAPHSWLPLEKGKLSKFAGHSTSSIESLMKMPEPVVLPHFKPADYVDILAQIHEELESCPPDEKSCLYLLQFQVFRGLGEVKLSRRSLQSAWEKASTIHEKLIFGAWLKYEKKGEEPISDLLSSCGKCSQEFKLLDFVSQISTGSHEISYDDESDVFWGSPVVHFRIRDDMIACDRRKLAALSTPLYAMLNGGFRESHLEVIDMSRNGISSIGMRAISKFSLTGRLPYLSADAILEMLDFANKFCCNGLKDACERKLASFICSRQDAIDFMECALELGCSILAAACLQVLLNELPECLNDEQVVRIFSCASKQQRSTMAGNASFSLYCLLSEVSMSINATSDVTVTFLEKLVDSASDSRQKQLALHQLACTRLLRKDYAEAERLFNAAFTAGHLYSVVGLARLASMRGNKHFSLKLLDSVMSSRWPLGWMYQERALYLEGDNKLENLNKATELDPTLTYPYMFRAASLMKRQSVEAALMEINRILGFKLVLECLELRFCCYLALEDHRAALCDVQAILTLAPDYRMIGGRVSAKQLRMLVMENVEQWTTADCWMQLYDRWSSVDDIGSLSVIYQMLESDAAKGVLYFRQSLLLLRLNCPEAAMRSLQLAREHAASQHEQLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNSRTGAYEEMTKLIEKARSNASAYEKRSEYCDRELTKSDLQMVTKLDPLRVYPYRYRAAVLMDNHKEKEAIAELTKAIAFKADLNLLHLRAAFHEHVGDISSALRDCRAALSVDPNHQEMLELHHRVNSQEP

SEQ ID NO: 2964 - protein, 886 aa, Oryza sativa Indica Group
MRKLFFSELTSCKETKLHSAPHSWLPLEKGKLSKFAGHSTSSIESLMKMPEPAVLPHFKPADYVDILAQIHEELESCPPDEKSCLYLLQFQVFRGLGEAKLSRRSLQSAWEKASTIHEKLIFGAWLKYEKKGEEPISDLLSSCGKCSQEFKLLDFVSQISTGSHEISYDDESDVFWGSPVVHFQIRDDMIACDRRKLAALSTPLYAMLNGGFRESHLEVIDMSRNGISSIGMRAISKFSLTGRLPYLSADAILEMLDFANKFCCNGLKDACERKLGSFICSRQDAIDFMECALELGCSILAAACLQVLLNELPECLNDEQVVRIFSCASKQQRSTMAGNASFSLYCLLSEVSMSINATSDVTVTFLEKLVDSASDSRQKQLALHQLACTRLLRKDYAEAERLFNAAFTAGHLYSVVGLARLASMRGNKHFSLKLLDSVMSSRWPLGWMYQERALYLEGDNKLENLNKATELDPTLTYPYMFRAASLMKRQSVEAALMEINRILGFKLVLECLELRFCCYLALEDHRAALCDVQAILTLAPDYRMIGGRVSAKQLRMLVMENVEQWTTADCWMQLYDRWSSVDDIGSLSVIYQMLESDAAKGVLYFRQSLLLLRLNCPEAAMRSLQLAREHAASQHEQLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNSRTGAYEEMTKLIEKARSNASAYEKRSEYCDRELTKSDLQMVTKLDPLRVYPYRYRAAVLMDNHKEKEAIAELTKAIAFKADLNLLHLRAAFHEHVGDISSALRDCRAALSVDPNHQEMLELHHRVNSQEP

SEQ ID NO: 2965 - protein, 857 aa, Oryza sativa Japonica Group
GKLSKFAGHSTSSIESLMKMPEPVVLPHFKPADYVDILAQIHEELESCPPDEKSCLYLLQFQVFRGLGEVKLSRRSLQSAWEKASTIHEKLIFGAWLKYEKKGEEPISDLLSSCGKCSQEFKLLDFVSQISTGSHEISYDDESDVFWGSPVVHFRIRDDMIACDRRKLAALSTPLYAMLNGGFRESHLEVIDMSRNGISSIGMRAISKFSLTGRLPYLSADAILEMLDFANKFCCNGLKDACERKLASFICSRQDAIDFMECALELGCSILAAACLQVLLNELPECLNDEQVVRIFSCASKQQRSTMAGNASFSLYCLLSEVSMSINATSDVTVTFLEKLVDSASDSRQKQLALHQLACTRLLRKDYAEAERLFNAAFTAGHLYSVVGLARLASMRGNKHFSLKLLDSVMSSRWPLGWMYQERALYLEGDNKLENLNKATELDPTLTYPYMFRAASLMKRQSVEAALMEINRILGFKLVLECLELRFCCYLALEDHRAALCDVQAILTLAPDYRMIGGRVSAKQLRMLVMENVEQWTTADCWMQLYDRWSSVDDIGSLSVIYQMLESDAAKGVLYFRQSLLLLRLNCPEAAMRSLQLAREHAASQHEQLVYEGWILYDTGHCEEGLQKAEASIAIQRSFEAFFLKAYALADSSLDPSTSATVVSLLEDALRCPSDRLRKGQALNNLGSVYVDCGKLDLAAECYINALKIGHTRAHQGLARVHFLRNSRTGAYEEMTKLIEKARSNASAYEKRSEYCDRELTKSDLQMVTKLDPLRVYPYRYRAAVLMDNHKEKEAIAELTKAIAFKADLNLLHLRAAFHEHVGDISSALRDCRAALSVDPNHQEMLELHHRVNSQEP

SEQ ID NO: 2966 - protein, 810 aa, Zea mays
MKMPEPAVLPYFKPANYVDILAQIHEELESCPPDEKSCLYLLQFQVFRGLGEAKLSRRSLQSAWEKASTIHEKLIFGAWLKYEKKGEEAISDLLSSCCKCSQEFRLLDFVSQVSTGSHMMNYDDDDDESDEFRGSAVVHFRIRDDMIACDRRKLAALSTPLYAMLNGGFRESYLEVIDMSRNGISPIGMRAISKFSLSGRLPYLSADAILEMLDFANKFCCKGLKDACERKLASFISSRQDAIDFMECALELGCSILAALCLQVLLNELPECLNDEQVVRIFSSANKAQRLTMVGNASFSLYCLLSEVSVSTNPTSDVTVSFLEKLVESASDSRQKQLALHQLACTRFLRKDYPESECLFNAAFSAGHLYSLVGLARLASLRGNKHFALKLLDSVMSSRWPLGWMYQERALYLDGDNKLENLNKATELDPTLTYPYMFRAASLMKRQSVEAALMEINRILGFKLVLECLELRFCCYLALEDYRAALCDVQAILTLAPDYRMIGGRVAAKQLRMLVLENVEQWTPADCWMQLYDRWSSVDDIGSLSVIYQMLESETAKGVLYFRQSLLLLRLNCPEAAMRSLQLAREHAASDHERLVYEGWILYDTGHCEEGLQKAEASIAIQRSFEAFFLKAYALADSSLDPSTTATVVSLLEDALRCPSDRLRKGQALNNLGSVYVDCGKLDLAAECYINALKIGHTRAHQGLARVHFLRNNRVGAYDETTKLIEKARNNASAYEKRSEYCERELTKTDLQMVTKLDPLRVYPYRYRAAGKCRLPASCCMAYLVSYTFNTTKLGRDVILAPPDSKQVET

SEQ ID NO: 2967 - protein, 886 aa, Vitis vinifera
MKNLFPSESCKETQLNAFNPQSWLQVERGKLSKFSSQSSSSIESLIKVPEPPILPFFKPVDYVEVLAQIHEELESCPPQERSNLYLLQFQVFRGLGEVKLMRRSLRSAWQRASTVQEKLIFGAWLKYEKQGEELIADLLASCGKCAQEFGPIDIASQLPADSNTSSNEAVVMNGNEILKTVIFRIGDEKIVCDRQKIAGLSAPFHAMLNGCFTESLQEDIDLSENNISPSGMRAIHEFCMTGSLGEVPPDLLLEILIFGNKFCCERLKDACGRKLASLVSSRDDAVELIDYALEENSPVLAASCLQVFLHELPDCLNDNRVLEILSDANRQQRSIMVGPASFSLYCFLSEVAMALDPRSDTTACFLERLVESAESSRQRLLACHQLGCVRLLRKEYDEAEQLFEAALNAGHVYSVAGLVRLGYLKGHKLWSYDKLSSVISSFTPLGWMYQERSLYCEGDKRWEDLEKATELDPTLTYPYMYRAASLMRKQNVQAALAEINQVLGFKLALECLELRFCFYLAVENYEAAFCDVQAILTLSPDYRMFEGRVAASQLRMLVREHVESWTTADCWLQLYDRWSSVDDIGSLSVIYQMLESDAAKGVLYFRQSLLLLRLNCPEAAMRSLQLARQHASNEHERLVYEGWILYDTGHCEEGLRKAEESIGLKRSFEAFFLKAYALADSSQDPSCSSTVVSLLEDALKCPSDRLRKGQALNNLGSVYVDCGKLELAADCYINALKIRHTRAHQGLARVHFLKNDKTAAYVEMTKLIEKARNNASAYEKRSEYCERELTKADLEMVTRLDPLRVYPYRYRAAVLMDSHKEKEAIAELSRAIAFKADLHLLHLRAAFHEHIGDVLGALRDCRAALSVDPNHQEMLELHSRVNSHEP

SEQ ID NO: 2968 - protein, 886 aa, Vitis vinifera
  misc_feature (640)..(647): Xaa can be any naturally occurring amino acid
MKNLFPSESCKETQLNAFNPQSWLQVERGKLSKFSSQSSSSIESLIKVPEPPILPFFKPVDYVEVLAQIHEELESCPPQERSNLYLLQFQVFRGLGEVKLMRRSLRSAWQRASTVQEKLIFGAWLKYEKQGEELIADLLASCGKCAQEFGPIDIASQLPADSNTSSNEAVVMNGNEILKTVIFRIGDEKIVCDRQKIAGLSAPFHAMLNGCFTESLQEDIDLSENNISPSGMRAIHEFCMTGSLGEVPPDLLLEILIFGNKFCCERLKDACGRKLASLVSSRDDAVELIDYALEENSPVLAASCLQVFLHELPDCLNDNRVLEILSDANRQQRSIMVGPASFSLYCFLSEVAMALDPRSDTTACFLERLVESAESSRQRLLACHQLGCVRLLRKEYDEAEQLFEAALNAGHVYSVAGLVRLGYLKGHKLWSYDKLSSVISSFTPLGWMYQERSLYCEGDKRWEDLEKATELDPTLTYPYMYRAASLMRKQNVQAALAEINQVLGFKLALECLELRFCFYLAVENYEAAFCDVQAILTLSPDYRMFEGRVAASQLRMLVREHVESWTTADCWLQLYDRWSSVDDIGSLSVIYQMLESDAAKGVLYFRQSLLLLRLNCPEAAMRSLQLARQHASNEHERLVXXXXXXXXTGHCEEGLRKAEESIGLKRSFEAFFLKAYALADSSQDPSCSSTVVSLLEDALKCPSDRLRKGQALNNLGSVYVDCGKLELAADCYINALKIRHTRAHQGLARVHFLKNDKTAAYVEMTKLIEKARNNASAYEKRSEYCERELTKADLEMVTRLDPLRVYPYRYRAAVLMDSHKEKEAIAELSRAIAFKADLHLLHLRAAFHEHIGDVLGALRDCRAALSVDPNHQEMLELHSRVNSHEP

SEQ ID NO: 2969 - protein, 886 aa, Solanum lycopersicum
MRTFFPSESCKETHLKSINPQSWLQVERGKLAKISSESASSIDSLIKVPEPPILPFFKPVDYVQVLAKIHEELESCSPQERSNLYLLQFQVFKGLGEVKLMRRSLRAAWSKASTVYEKLVFGAWLKYEKQDEELISDLLSSCGKCAKEFGAIDIASEMPAYKKLSSHGVITTNEDSCPRTVSFRIADEKIACDRQKIASLSAPFHTMLNGCFTESFCEEIDLSENNISPLAMRLINEFSSTGLLNEVSPDLLLEILVFANKFCCESLKDACDRKLASLISCRQDALELLECALEENSPVLAASCLQVFLRELPDSLKDSQVVELLSNTTRQQRSIMIGPASFSLYCLLSEVSMNLDPRSDESVRFLRTLVDSAETSQQKMVAYHRLGCVKFLREELDEAEQLFEAAFNLGHTYSVIGLARLGQIRGHKRWAYEKLGSVISSSIPLGWMYQESSLYCEGEKRWDDLEKATELDPTLTYPYMYRAASLMRKQNAQAALSEINRILGFKLALECLELRFCFYLALEDYQLAICDIQAILTLCPDYRVFEGRVAASQLRTLLREHVENWTEADCWLQLYDRWSSVDDIGSLSVIYQMLESDAAKGVLYFRQSLLLLRLNCPDAAMRSLQLARQHSSSEHERLVYEGWILYDTGHCEEGLQKAEESISIKRSFEAFFLKAYALADSSLDASCSSTVISLLEDALRCPSDRLRKGQALNNLGSVYVDCGKLDAAADCYINALKIRHTRAHQGLARVHFLRNDKVAAYDEMTKLIEKAKNNASAYEKRSEYCDRDRTKADLEMVTRLDPLRVYPYRYRAAVLMDNHQDKEAIEELSRAIAFKADLHLLHLRAAFHEHIGDVMGALRDCRAALSVDPKHQEMLELHSRVNSQEP

SEQ ID NO: 2970 - protein, 886 aa, Solanum lycopersicum
MRTFFPSESCKETHLKSINPQSWLQVERGKLAKISSESASSIDSLIKVPEPPILPFFKPVDYVQVLAKIHEELESCSPQERSNLYLLQFQVFKGLGEVKLMRRSLRAAWSKASTVYEKLVFGAWLKYEKQDEELISDLLSSCGKCAKEFGAIDIASEMPAYKKLSSHGVITTNEDSCPRTVSFRIADEKIACDRQKIASLSAPFHTMLNGCFTESFCEEIDLSENNISPLAMRLINEFSSTGLLNEVSPDLLLEILVFANKFCCESLKDACDRKLASLISCRQDALELLECALEENSPVLAASCLQVFLRELPDSLKDSQVVELLSNTTRQQRSIMIGPASFSLYCLLSEVSMNLDPRSDESVRFLRTLVDSAETSQQKMVAYHRLGCVKFLREELDEAEQLFEAAFNLGHTYSVIGLARLGQIRGHKRWAYEKLGSVISSSIPLGWMYQESSLYCEGEKRWDDLEKATELDPTLTYPYMYRAASLMRKQNAQAALSEINRILGFKLALECLELRFCFYLALEDYQLAICDIQAILTLCPEYRVFEGRVAASQLRTLLREHVENWTEADWWLQLYDRWSSVDDIGSLSVIYQMLESDAAKGVLYFRQSLLLLRLNCPDAAMRSLQLARQHSSSEHERLVYEGWILYDTGHCEEGLQKAEESISIKRSFEAFFLKAYALADSSLDASCSSTVISLLEDALRCPSDRLRKGQALNNLGSVYVDCGKLDAAADCYINALKIRHTRAHQGLARVHFLRNDKVAAYDEMTKLIEKAKNNASAYQKRSEYCDRDRTKADLEMVTRLDPLRVYPYRYRAAVLMDNHKDKEAIEELSRAIAFKADLHLLHLRAAFHEHIGDVMGALRDCRAALSVDPKHQEMLELHSRVNSQEP

SEQ ID NO: 2971 - protein, 340 aa, Sorghum bicolor
MHIALSVCVTACKLKQQLLLDRGMMSERNLLARRQPLPPAIAVAVVVVAVLVHPRAVAVAQAQPSPGYFPSATVRSMAFSEDYDNLWGPQHQTLSQDKMALTLLMDRTSGSGFKSKRSYRNGYFGVSIKVQPGYTAGVNTAFYLSNNELYPGKHDEIDIELLGTVPGEPYTLQTNVYVRGTGDGAHLVGREMRFHLWFDPTADFHHYAILWNPDEIVFLVDDVPIRRYAAASTTLFPDREMWAYGSIWDASDWATDGGRYRADYRYQPFLAGFRTFRTAGCEAAAPAAGCPPVPASPAGAGLSVQQRDAMRWAQQRSMVYYYCQDYTKDRSLYPECSLAT

SEQ ID NO: 2972 - protein, 301 aa, Zea mays
MTMSIVAAVLLLLLVHVHPRAAAAQPSPGYFPSSTVRPMAFSDGYDNLWGPQHQTLSQDRMALTLLMDRTSGSGFKSKRSYRNGYFGVSIKVQPGYTAGVNTAFYLSNNELYPGRHDEIDMELLGTVPGEPYTLQTNVYVRGTGDGARLVGREMRFHLWFDPAADFHHYAILWNPDQIVFLVDDVPIRRYAAASAPFFPDRQMWAYGSIWDASDWATDGGRYRADYSYQPFLAGFRGFRTAGCEAAAPAQCRPVPASPAGAGLSVQQRDAMRWAQQTSMVYYYCQDYTKDRSLYPECSLAS

SEQ ID NO: 2973 - protein, 297 aa, Zea mays
MTMSIVAAVLLLLLVVHPRAAASQPSPGYFPSSTVRPMAFSDGYDNLWGPQHQTLSQDRMALTLLMDRTSGSGFKSKRSYRNGYFGVSIKVQPGYTAGVNTAFYLSNNELYPGRHDEIDMELLGTVPGEPYTLQTNVYVRGTGDGARLVGREMRFHLWFDPAADFHHYAILWNPDQIVFLVDDVPIRRYAAASAPFFPDRQMWAYGSIWDASDWATDGGRYRADYRYQPFLAGFRGFRTAGCEDAQCRPVPASPAGAGLSVQQRDAMRWAQQTSMVYYYCQDYTKDRSLYPECSLAS

SEQ ID NO: 2974 - protein, 416 aa, Sorghum bicolor
MHIAQTNPRFHRAAIPPNSQQAQMAAVGTLPGAAAVAGASVRQRQCRGAAPSFVAAYVREGTRLVYGRQLRPAPVLACPARRRFLGAAAAAASSGSAGDAEPQGFAERYPTLVTGFFFFLWYFLNVIFNILNKKIFDYFPYPYFVSVSHLFIGVLYCLIGWSFGIPKRAPINSTLLKQLLPVAVCHAIGHVTSTVSFAAVAVSFAHTIKALEPFFNAAASQFILGQPVPLTLWLSLVPVVVGVSVASLTELSFNWTGFINAMISNISFTYRSIYSKKAMTDMDSTNLYAYISIIALFVCIPPALIIEGPQLMQHGFKDAIGKVGLTKLISNFFVVGLFYHLYNQVATNTLERVAPLSHAIGNVLKRVFVIGFSIIVFGNKITTQTGIGTSIAISGVALYSFIKAKIEEEKKQIKSA

SEQ ID NO: 2975 - protein, 399 aa, Zea mays
MAAAGTIPGAAAAIGASVSQRQRRVGAPSFVAAYVSEGTRLVCRRQLRPAPVLASSFISLSHPARRRFLCDAAAGASSGPAGEAKPQGFAERYPALVTGFFFFLWYFLNVIFNILNKKIFDYFPYPYFVSVSHLFIGVLYCLIGWSFGIPKRAPINSTLLKQLVPVAVCHAIGHVTSTVSFAAVAVSFAHTIKALEPFFNAAASQFILGQPVPLTLWLSLVPVVIGVSVASLTELSFNWTGFINAMISNISFTYRSIYSKKAMTDMDSTNLYAYISIIALFVCIPPAIIIEGPQLVQHGFKDAIAKVGLTKLISNFFVVGLFYHLYNQVATNTLERVAPLTHAIGNVLKRVFVIGFSIIAFGNKITTQTGIGTSIAVSGVALYSFIKAKIEEKKQIKSA

SEQ ID NO: 2976 - protein, 399 aa, Zea mays
MAAAGTIPGAAAAIGASVSQRQRRVGAPSFVAAYVSEGTRLVCRRQLRPAPVLASSFISLSHPARRRFLCDAAAGASSGPAGEAKPQGFAERYPALVTGFFFFLWYFLNVIFNILNKKIFDYFPYPYFVSVSHLFIGVLYFLIGWSFGIPKRAPINSTLLKQLVPVAVCHAIGHVTSTVSFAAVAVSFAHTIKALEPFFNAAASQFILGQPVPLTLWLSLVPVVIGVSVASLTELSFNWTGFINAMISNISFTYRSIYSKKAMTDMDSTNLYAYISIIALFVCIPPAIIIEGPQLVQHGFKDAIAKVGLTKLISNFFVVGLFYHLYNQVATNTLERVAPLTHAIGNVLKRVFVIGFSIIAFGNKITTQTGIGTSIAVSGVALYSFIKAKIEEKKQIKSA

SEQ ID NO: 2977 - protein, 404 aa, Oryza sativa Japonica Group
MAAARALLPVGGAAAVAVPRRLRSGEASSTSLSGPVSDGARLVRRMQLRPAPLLGSSTCALPSLRGKRLIRTPAASSSSSSLDSTGEAKPVGFAERYPALVTGFFFFMWYFLNVIFNILNKKIFDYFPYPYFVSVSHLLVGVLYCLVGWSFGLPKRAPINSTVLKLLFPVAVCHAIGHVTSTVSFAAVAVSFAHTIKALEPFFNAAASQFILGQQVPLTLWLSLAPVVIGVSMASLTELSFNWTGFVNAMISNISFTLRSVYSKKAMTDMDSTNLYAYISIIALLVCIPPAIIIEGPQLVQHGFKDAIAKVGLAKLVSNLLVVGLFYHLYNQVATNTLERVTPLTHAVGNVLKRVFVIGFSIIAFGNKITTQTGIGTCIAIAGVALYSYIKAKIEEEKTQMKSA

SEQ ID NO: 2978 - protein, 406 aa, Hordeum vulgare subsp. vulgare
MAAVATILCGGGAAVAGHQRFRRRGAPSLHARGNPVSDGAHLVCGGKLRPALFPASSFGTVSLPSPGSRRLPRTSASGPSSDSQGQAKPIGFLERYPALVTGFFFFMWYFLNVIFNILNKKIFDYFPYPYFVSVTHLSVGVLYCLISWGTGLLKRAPMNSTLLKLLLPVAICHAIGHVTSTVSFAAVSVSFAHTIKALEPFFNAAASQFILGQQVPFTLWLSLAPVVIGVSIASLTELSFNWTGFINAMISNISFTYRSIYSKKAMTDMDSTNLYAYISIIALIVCIPPALIIEGPQLVQHGFKDAIAKVGLTKLVSNIFLAGLFYHLYNQVATNTLQRVAPLTHAVGNVLKRVFVIGFSIIIFGNKITTQTGIGTAIAISGVALYSVIKAKIEEEKKEGVPAVAP

SEQ ID NO: 2979 - protein, 283 aa, Zea mays
MHDLDRQSVLMHTSISHEATTFARSIARARSRGRASSPFGVALQEPDHLVGRDVAPHPGPRGAVAELGEAVRHPVTPAPHVRDAHVVEQQQQLLDLPEQAQVLRGPYPHARAAPHGVDHRHGVALDPDAAPAVGHRELQPAPERRELRHGAGRGADPLRVAQHEPALVVAVHAADARAPGRVPRRPVEVELQSPGLRLPPRARRRLRSRRPVVITPAQPPAPARRRPSAADEAGRQRVAQQHAASDKRTVHPQHRSPASNCCAANFDAHLAPVHALCLKRSLA

SEQ ID NO: 2980 - protein, 506 aa, Sorghum bicolor; identical to SEQ ID NO: 359

SEQ ID NO: 2981 - protein, 506 aa, Zea mays; identical to SEQ ID NO: 360

SEQ ID NO: 2982 - protein, 506 aa, Zea mays; identical to SEQ ID NO: 361

SEQ ID NO: 2983 - protein, 507 aa, Oryza sativa Indica Group; identical to SEQ ID NO: 362

SEQ ID NO: 2984 - protein, 507 aa, Oryza sativa Japonica Group; identical to SEQ ID NO: 363

SEQ ID NO: 2985 - protein, 505 aa, Hordeum vulgare subsp. vulgare; identical to SEQ ID NO: 364

SEQ ID NO: 2986 - protein, 497 aa, Oryza sativa Indica Group; identical to SEQ ID NO: 365

SEQ ID NO: 2987 - protein, 546 aa, Zea mays
MFATFLLLLWSHAPAPALSLPPRPPVRCSDGGTTGCVLSNAYGAWSSDRADCPVSSVAYPASEQEVVAAVARASASGARVKVVSGFAHTIPKLACPGGGNGTTTTLLISLTAAPYWEGVSVAGLVSTGSHGSSWWGRGGAVHDHVVGLRLVVTAGEADGWARVLTLRRGDELFPAALVSLGLLGVVSKITLSLEPRFKRSITFDYRNDSTFQDDFAAHAASHEFADITWYPSQHTAVYRIDDRAPANAPGDGVNDFIGFQATPIAVTAGLRVVETSLERSKNMKGKCAMAAAEGVAKRLVGNGLKNNGLLFTGYPVVGYQGKMQTSGSCARSSAADLLSACGWDPRFHGLFFYESTAIFSPARFRDFILDVKRLRDLAGSDSLCGVDVYNGLLVRFVKASAAHLGQPEDSVVVDFNYYRASDSAAPRLSQDVWEEVEQLAFVKHGARPHWAKNRLVAFAGVRGKYPRWGQFAAAKRQLDPRGLFDSPWSDEVVGGVELAKGDGCALDGRCVCSEDRHCSPEQGYYCRPGLVFTDARVCRYSGSQNQ

SEQ ID NO: 2988 - protein, 583 aa, Sorghum bicolor
MLATFLLLLLSSHAPAPVLSLPPRPPVRCTSTGCVLSNAYGAWSSDRADCPVSAVAYPATEQEVVAAVARASATGARVKVVSGFAHTIPKLACPGGGTGNGTTLLISTARLAGVEEVDVAARTVTADAGAPLRAVIDAAEARGLSLAAAPYWEGVSVAGLVSTGSHGSSWWGRGGAVHDHVVGLRLVVAAGEADGWARVVTLRAGDELFPAALVSLGLLGVITKITLSLEPRFKRSITYDYRDDSTFQDDFAAHAASHEFADITWYPSQHTAVYRIDDRLPLDAPGDGVNDFIGFQATPIAVTAGLRAVETSLERSKNVRGKCVTAKAEGAAKRLVGSGLKNDGVLFTGYPVVGYQGKMQTSGSCARSSAADLLSACGWDPRFHGLFFYESTAIFSPPARFRDFILDVKRLRDLAGSDSLCGVDVYNGLLVRFVKASAAHLGQPEDSVVVDFNYYRASDPAAPRLSEDVWEEVEQLAFVKHGARPHWAKNRLVAFAGVRGKYPRWAQFAAAKRELDPRGLFDSPWSDEVVGAVEVAKGDGCALDGRCVCSEDRHCSPGQGYYCRPGLVFTDARVCRYSVSQSQ

SEQ ID NO: 2989 - protein, 582 aa, Hordeum vulgare subsp. vulgare
MAAFLLLVLCSLAPGALSVPPRPPVRCGDAGCVLSNAYGAWSSDRADCPVSAVAYPASERDVVAAVARASAGGMRVKAVSGFAHTIPKLACPGGGGGGNGSAASLLISTARYAGVEVDAAARTVTADAGAPLRAVIDAAEASGLSLPASPYWEGVSVGGAVSTGSHGSSWWGRGGALHDHVVGLSLVVPAGAADGWAKVVPLARGDALFPAALVSLGLLGVISKVTLALEPRFKRSVTYDYRDDSTFQDDFADHAARHEFADIAWYPSQHQAVYRLDDRAPLNATGDGVNDFIGFRSTLIAVSQGVRALETALEGSRNVKGKCAMAAAEIAAKRLIGNGLRRKAGQLFTGYPVVGFQGQMQTSGSCARSPASSPLTACAWDPRFKGLFFYESTAIFSPARFRSFVLDVKRLRDLSPDSMCGVDVYNGLLVRFVRRSEAWLGQPEDSVVVDFNYYRAADPSAARLSQDVWEEVEQMAFVKHGARPHWAKNRMVAFRGVQGKYPGWARFAAAKRQLDPRGLFDSPWSDDVVGGKELGKEDGCALDGGCVCSEDRHCSPEQGYYCRTGLVFTEARVCRYSASQLV

SEQ ID NO: 2990 - protein, 592 aa, Oryza sativa Japonica Group
MVATFLLPLLLSTLLPAAVPLPPRPPVRCGGSGGAGGDGAGCVLSNAYGAWSSDRADCPVSAVAYPASEADVVAVVADASAKNMPVKVVSGFAHTIPKLACPGNGSSGAASSLLISTARYDGVAVDAAARTVTADAGAPLRAVIDAAEASGLSLTAAPYWEGVSVGGLVSTGSHGSSWWGRGGAVHDHVVALRLVVPAGAADGWAKVVALRRGDALFNAALVSLGLLGVISKVTLALEPRFKRSISYEYRDDSTFQDDFARHAANHEFADITWYPSQHKAVYRIDDRMPLNATGDGVNDFIGFQSTLIAVSSGIRALETALEASRNVKGKCKMAAAEIAAKRLVGNGLRGAGGRLFTGYPVVGFQGRMQTSGSCARSPPTDTLSACPWDPRYKGLFFYESTAMFSPAARFRDFVLDVKRLRDVDPDSMCGVDAYNGLLVRFVKASEAYLGQPEDTVVVDFNYYRASDGSSPRLSQDVWEEVEQLAFVKHGARPHWAKNRLAAFRGVRGKYPSWDKFGAAKRQLDPRGLFDSRWSDEVVGGEEQLPKADGCALEGRCVCSEDRHCSPSKGYYCRPGLVYSEARVCRYSVSQLV

SEQ ID NO: 2991 - protein, 592 aa, Oryza sativa Indica Group
MVATFLLPLLLSTLLPAAVPLPPRPPVRCGGSGGAGGDGAGCVLSNAYGAWSSDLADCPVSAVAYPASEADVVAVVADASAKNMPVKVVSGFAHTIPKLACPGNGSSGAASSLLISTARYDGVAVDAAARTVTADAGAPLRAVIDAAEASGLSLTAAPYWEGVSVGGLVSTGSHGSSWWGRGGAVHDHVVALRLVVPAGAADGWAKVVALRRGDALFNAAVVSLGLLGVISKVTLALEPRFKRSISYEYRDDSTFQDDFARHAANHEFADITWYPSQHKAVYRIDDRMPLNATGDGVNDFIGFQSTLIAVSSGIRALETALEASRNVKGKCKMAAAEIAAKRLVGNGLRGAGGRLFTGYPVVGFQGRMQTSGSCARSPPTDTLSACPWDPRYKGLFFYESTAMFSPAARFRDFVLDVKRLRDVDPDSMCGVDAYNGLLVRFVKASEAYLGQPEDTVVVDFNYYRASDGSSPRLSQDVWEEMEQLAFVKHGARPHWAKNRLAAFRGVRGKYPSWDKFGAAKRQLDPRGLFDSRWSDEVVGGEEQLPKADGCALEGRCVCSEDRHCSPSKGYYCRPGLVYSEARVCRYSVSQLV

SEQ ID NO: 2992 - protein, 808 aa, Sorghum bicolor
MKGAMPPRPFMMPGPGGPMPPPQQQFGLVETRPPLAAVLRPRFNIPGLHPSAAAAAAATGAGKIASTYDLVEPMRFLYVHVVKARDLPAVSATGAIDPFVEVKLGNFKGTTAVKAASHNPSWQQVFAFSATHLQSHLLEVALKAKDLAGDDLVGRVVFDLAEVPVRVPPDSPLAPQWYRLEAKRGDKLPHGEIMLSVWLGTQADEAFPDAWHSDAHAAAGPAAVASTRAKVYFSPKLVYLRVAAIGAQDLIPHDTSRPMSACVKLQLAGQVRRTRPGAPPGTPNPIWNEEFMFVASEPFDEPLVVTVEDRVAPGRDEMLGRIVLPLAAAMPRHDHFGKPVEPRWYSLMRPSDDPDKKEIKFASKIQIRMSLDFGYHVLDESTYYSSDLQPSSKPARKPSIGMLELGVLGARNLIPMKPKDGRTTDAYCVAKYGPKWVRTRTILDTLNPQWNEQYTWEVFDPCTVITVVVFDNGQIGKNGGGPDQRIGKVRIRLSTLETDRVYTHFYPLLVLHPSGLKKTGELHLAVRFTCTAWVNMMALYGRPLLPKMHYTQPIAVMQLDYLRHQAMQIVAARLSRAEPPLRREIVEYMLDVDSHMFSLRRSKANFHRITSLFFGFLAMLKWYDGIRSWRNPITTMLVHMLFLILICYPELILPTVFLYMFMIGLWNYRYRPRHPSHMDTKLSHAELTHPDELDEEFDTFPSSRPAEIVRMRYDRLRSVGGRVQTVVGDLATQGERAHALLSWRDPRATAIFIFLSLVVAIVLYVTPFQVLMVIGMLYLLRHPRFRSRMPSVPFNFYRRLPAKSDMLL

SEQ ID NO: 2993 - protein, 809 aa, Zea mays
MKGAMPPRQFMVPGPGGPMLPPQQQFGLVETRPPLAAVLRPRFNIPGLHPSAAAAAAASGAGKIASTYDLVEPMRFLYVHVVKARDLPAVSATGAIDPFVEVKLGNFKGTTPVRAASHNPSWQQVFAFSATHLQSHLLEVALKAKDLAGDDLVGRVAFDIAEVPVRVPPDSPLAPQWYRLETKRGEKLPHGEIMLSVWLGTQADEAFPDAWHSDAHAAAGPAAVASTRAKVYFSPKLVYLRVAAIAAQDLIPHDTSRPMSACVKLQLAGQLRRTRPGAPPGTPNPIWNEEFMFVASEPFDEPLVVTVEDRVAPGRDEMLGRIFLPLAAAMPRHDHFGKPVEPRWYSLMRPSDDPDKKEVKFASKIQIRMSLDFGYHVLDESTYYSSDLQPSSKPARKPSIGMLELGVLGARNLVPMKPKEGRTTDAYCVAKYGPKWVRTRTILDTLNPQWNEQYTWEVFDPCTVITVVVFDNGQIGTKNGGGPDQRIGKVRIRLSTLETDRVYTHFYPLLVLNPSGLKKTGELHLAVRFTCTAWVNMMALYGRPLLPKMHYTQPIAVMQLDYLRHQAMQIVAARLSRAEPPLRREVVEYMLDVDSHMFSLRRSKANFHRITSLFFGFLAMLKWYDGIRSWWNSITTMLVHVLFLILICYPELILPTIFLYMFMIGLWNYRFRPRHPSHMDTKLSHAELTHPDELDEEFDTFPSSRPAEIVRMRYDRLRSVGGRVQTVVGDLATQGERAHALLSWRDPRASAIFVFLSLVVAVVLYVTPFQVLMVIGMLYLLRHPRFRSRMPSVPFNFYRRLPAKSDMLL

SEQ ID NO: 2994 - protein, 805 aa, Hordeum vulgare subsp. vulgare
MRGQMQPRPFMMHGGPMPPPQQQFGLTETRPPLAAMLRPRFNIPGLNPSAAAANAAGKISSTYDLVEPMRFLYVHVVKARDLPGVSPTGSIDPFVEVKLGNFKGSTAVLPGNHTPSWHQVFAFSATHLQSHLLEVALKAKDLAGGDDLVGRMVFDLSEVPVRVPPDSPLAPQWYRLDGKRGEKLQRGEIMLSVWLGTQADEAFPEAWHSDAHGAASPSAVASTRAKVYFSPKLVYLRVAAIGAQDLVPHDTSRPMNASVKLQLAGQVRRTRPGAPPGTPNPMWNEEFMFVASEPFDEPLLVTVEDRVGPGRDEPLGRIMLPLNAAMPRHDHFGKPVEPRWYSLARPSDDGEKKEGKFASKIQLRMSLDFGYHVLDESTYYSSDLQPSSKHTRKPSIGILEVGILGARNLIPMKAKDGRTTDAYCVAKYGPKWVRTRTILNTLNPQWNEQYTWEVFDPCTVITVVVFDNTQIGSKNGDARDESIGKVRIRLSTLETDRVYTHFYPLLALKPSGLKKTGELHLAVRFTCTAWVNMMAMYGRPLLPKMHYSQPISVMQLDYLRHQAMQIVSARLSRAEPPLRREVVEYTLDVGSHMFSLRRSKANFYRITSLFCGFASMAKWYDGIRSWRNPITTMLVHMLFLILICYPELILPTIFLYMFMIGIWNYRYRSRHPPHMDTKLSQAEFTHPDELDEEFDTFPSNRPADIVRLRYDRLRSVGGRVQTVVGDLATQGERAHALLSWRDPRATAIFIFLSLVVAIVLYVTPFQVLLVITMLYLLRHPRFRSRMPSVPFNFYRRLPAKSDSLI

SEQ ID NO: 2995 - protein, 804 aa, Oryza sativa Indica Group
MKGAMPPRPFMMPGPGGPMPPPQQFGLVETRPPLAAVLRPRFNIPGLHPSAAAASAAGKIASTYDLVESMRFLYVHVVKAKDLPAVSAAGTIDPFVEVKLGNFKGTTPVLGGNHNPSWKQVFAFSATHLQAHVLEVAVKAKDLAGGDDLIGRVGFDLSEVPIRVPPDSPLAPQWYRLENKRGEKTRGEIMLSVWLGTQADEAFPDAWHSDAHAAAGPGAVASTRAKVYFSPKLVYLRVAAIGAQDLVPLDASRPANACVKLQLAGQVRRTRPGAPPGTLNPIWNEEFMFVVSEPFDEPLFVTVEDRVGPGRDEPLGRIMLPLNAAMPRHDHFGKPVEPRWYSLARPSDDPDKKEGKFASKIQLRMSLDFGYHVLDESTYYSSDLQPSSKHTRKPSIGILELGILGARNLIPMKGKDGRTTDAYCVAKYGPKWVRTRTILNTLNPQWNEQYTWEVFDPCTVITVVVFDNNQIGKNGDARDESIGKVRIRLSTLETDRVYTHFYPLLALKPSGLKKTGELHLAVRFTCTAWVNMIALYGRPLLPKMHYTQPISVMQLDYLRHQAMQIVAARLSRAEPPLRREVVEYMLDVGSHMFSLRRSKANFYRITSLFCGFAATAKWYDGIRSWRNPITTVLVHMLFLILICYPELILPTIFLYMFMIGLWNYRYKPRHPPYMDTKLCHAEFTNPDELDEEFDSFPSSRPADIVRMRYDRLRSVGGRVQTVVGDLATQGERAHALLSWRDPRATAIFIFLSLVVAIVLYVTPFQVLLVIAMLYLLRHPRFRSRMPSVPFNFYRRLPAKSDMLL

SEQ ID NO: 2996 - protein, 804 aa, Oryza sativa Japonica Group
MKGAMPPRPFMMPGPGGPMPPPQQFGLVETRPPLAAVLRPRFNIPGLHPSAAAASAAGKIASTYDLVESMRFLYVHVVKAKDLPAVSAAGTIDPFVEVKLGNFKGTTPVLGGNHNPSWKQVFAFSATHLQAHVLEVAVKAKDLAGGDDLIGRVGFDLSEVPIRVPPDSPLAPQWYRLENKRGEKTRGEIMLSVWLGTQADEAFPDAWHSDAHAAAGPGAVASTRAKVYFSPKLVYLRVAAIGAQDLVPLDASRPANFCVKLQLAGQVRRTRPGAPPGTLNPIWNEEFMFVVSEPFDEPLFVTVEDRVGPGRDEPLGRIMLPLNAAMPRHDHFGKPVEPRWYSLARPSDDPDKKEGKFASKIQLRMSLDFGYHVLDESTYYSSDLQPSSKHTRKPSIGILELGILGARNLIPMKGKDGRTTDAYCVAKYGPKWVRTRTILNTLNPQWNEQYTWEVFDPCTVITVVVFDNNQIGKNGDARDESIGKVRIRLSTLETDRVYTHFYPLLALKPSGLKKTGELHLAVRFTCTAWVNMIALYGRPLLPKMHYTQPISVMQLDYLRHQAMQIVAARLSRAEPPLRREVVEYMLDVGSHMFSLRRSKANFYRITSLFCGFAATAKWYDGIRSWRNPITTVLVHMLFLILICYPELILPTIFLYMFMIGLWNYRYKPRHPPYMDTKLCHAEFTNPDELDEEFDSFPSSRPADIVRMRYDRLRSVGGRVQTVVGDLATQGERAHALLSWRDPRATAIFIFLSLVVAIVLYVTPFQVLLVIAMLYLLRHPRFRSRMPSVPFNFYRRLPAKSDMLL

SEQ ID NO: 2997 - protein, 220 aa, Sorghum bicolor
MACTVASRRAVPLVRALEKLLAASSAPGAGSTLRPVAVAGGLRGYNTGAQLRRYEGRESEDDSVREYESRRGSRDYAAPSLFSDVFRDPFSAPQSLGRLLSLMDDFAVAAPGRAGAVRRGWNAKEDEEALHLRVDMPGLGKEHVKVWAEQNSLVIKGEGEKESGEDEDVPPPRYSGRIELAPEVYKMDKIKAEMKNGVLKVVVPKVKEEQRKDVFQVNVE

SEQ ID NO: 2998 - protein, 218 aa, Zea mays
MASIVASRRAVPLVRSLEKLIAASSAPGTGSALRPVAVAGGLRGYNTGAPLRRYEGAESEDDSVREYDGRHGGRDYAVPSLFSDIFRDPLSAPHSIGRLLNLMDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVE

SEQ ID NO: 2999 - protein, 218 aa, Zea mays
MASIVASRRAVPLVRALEKLIAASSAPGTGSALRPVAVAGGLRGYNTGAPLRRYEGAESEDDSVREYDGRHGGRDYAVPSLFSDIFRDPLSAPHSIGRLLNLVDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVE

SEQ ID NO: 3000 - protein, 219 aa, Zea mays
MASIVASRRAVPLVRALEKLIAASSAPGTGSALRPVAVAGGLRGYNTGAPLRRYEGAESEDDSVREYDGRHGGRDYAVPSLFSGNIFRDPLSAPHSIGRLLNLVDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVE

SEQ ID NO: 3001 - protein, 220 aa, Oryza sativa Japonica Group
MASIVASKRIPLFRLVEQLLAASPAQGAASALRPVAVAGGSRAYNTGAQLRRHERDESDDDSGRGYDTRRPTRDATMPAFFSDVFRDPFSAPQSLGRLLSLMDDLATPAGRAGAATLRRGWNAKESEEALHLRVDMPGLGKEHVKVWAEQNSLVIKGEGEKEAGEDEGAAPARYSGRIELAPEVYRMDQIKAEMKNGVLKVVVPKVKEEQRRDVFQVNVE

SEQ ID NO: 3002 - protein, 585 aa, Sorghum bicolor
MDSHSSPSAAPPAAAEAGRYTYSPRLRWQPEVEEYFAAAYGRDHFARISEALAHPSCYSCIRVNTLKSSTDAVMHKLMDLVCENELSAAINGVEAVELNGGEQPHEGSSLVHKCPYAGLENVLFVQGSGPHVLYYGSQPDQAVKEVVVSRKCAESVLRGAQVYVPGVLACSSHVEKGDKVAVSVAIEQPVKEDGWAVGITRGTVLQGLQSDAHYEERTGLYIGQGTAAMSRSALFRVPHGIAVEMTETTQKAPMYNDVLEGEIFLQNLPSVVTTHFIDPQSGERILDMCAAPGGKTTAIAILMRDKGEVVALDRSHNKVMDILKLASEMDLSCIKAYKLDALKSVRKTDESRNLGMAHNHSEAIETPTEDPCHATIDGSSTSVDEGNSTTTVVHSDDKNLNAKRYISKAELRKNLRRMKNGPGRNNCSGGRVEKSKGFYPNSFDRVLLDAPCSALGLRPRLFAGEETLESLKNHAKYQRRMFDQAVKLVRPGGVIVYSTCTINPGENEALVRYALDTYKYLSLVSQYPKVGGPGIVGSCELFNMTYTEEWLREDEAELVQRFDPSSSVDTIGFFIAKFNVGDKDE

SEQ ID NO: 3003 - protein, 585 aa, Zea mays
MDSHSPTSAAPPAAAETARYTYSPRLRWQPEVEEYFNTAYGRDHFARISEALAHPSCYSCIRVNTLKSSTDAVMHKLLDLVCKNELSAVINGLEVVELNGGDQSQEGCSLVHKCPYAGLENVLFVQGSGPHVLHYGSQPDQAVKEVVVSRKCAESVLRGAQVYVPGVLACSSHVEKGDKVAVSVAIEQPVKEDGWAVGITRGTVLQGLQSDAHYEERKGLYIGQGTAAMSRSAIFRVPHGIAVEMTERVYKLPSFNDVLEGEIFLQNLPSVVTARVLDPQSGERILDMCAAPGGKTTAIAILMRDEGEVVALDRSHNKVMDILKLASEMDLSCIKAYKLDALKSVRKTDEARSLGMADNHSEAIETPTEDPCHATVGGRSTSVDEDSSTTTVVFSDNKNLNSKRYISKAELRKNLRQMKNGPGRNNCSGGRVEKSKGFCPNSFDRVLLDAPCSALGLRPRLFAGEETLESLKKHSKYQRKMFDQAVKLVRPGGVIVYSTCTINPGENEALVRYALDTYKFLSLVSQYPKVGGPGIVGSCELFNKTYTEEWLREDEADLVQRFDPSSSVDTIGFFIAKFDVGEKDE

SEQ ID NO: 3004 - protein, 589 aa, Oryza sativa Japonica Group
MDSSASASASPTAAAAADADRYTYSPRLRWQPEVEEYFAAAYGRDRFARISEALAHPSCYSCIRVNTLKSSTDAVMHKLMNLVDQNGLCGGINGLEIGQQNGGEQAHEGNSVVHKCPYSGLDNVLFVQGSGPHALHYNSQPDQSIKEVIVSRKCAESVLRGAQVYIPGVLACSSHVEKGDKVAVSVAIEQPAEDGGWTVGITRGTVLQGLQSDAHHEERKGLYIGQGITAMSRSGIFRVPHGVAVEMTERVYKLPSFNDVLEGEIFLQNLPSVVAARVLDPQPGERILDMCAAPGGKTTAIAILMKDQGEIIALDRSHNKVMDILKLAAEMDLNCIKAYKLDALKSVRKTNEAKYIGEAGSRTDAIVTLAEDSEPCINKVDAGTTNASEDSSTTSVVQTDNKKTDDKRYVSKADLRKNLRRMRNGPGRNNCSGGRVENSKGFLPNSFDRVLLDAPCSALGLRPRLFAGEETLESLRNHATYQRRMFDQAVKLVHPGGVIVYSTCTINPGENEALVRYALDKYKFLSLGSQHPKVGGPGIVGSFERSTKKYTEEWLTKHESQLVQRFDPSSTLDTIGFFIAKFDVGQKDD

SEQ ID NO: 3005 - protein, 905 aa, Zea mays
MANPTATKHAFKRILTSLLKPGGGEYGKFFSLPALNDPRIDKLPYSIRVLLESAIRHCDNFQVTESDVEKIIDWENTSPKLAEIPFKPARCILMDNTGVPAVVDLAAMRDMMPKLGCDPYKINPLIPVDAVIDHAVRVDVAGTYDALDRNEELEFQRNKERFAFLKWASNAFHNMQVFPPGSGTVHQVNLEYLARVVFNEDGILYFDSVVGTDSHTTMINSLGVAGWGVGGIEAVVAMLGQPMGMVLPGVVGFKLSGKLRDGVTTTDIVLTMTQMLRKHGAIGKFVEFYGVGVGELSLPARATIANMSPEYGATMGFFPVDQVALDYLKLTGRSDETVSMIEAYLRANKMFVDKHEPETERVFSSHLELDLSEVEPCVSGPKRPHDRVPLKEMKSDWHACLDNEVGFKGYAVPKEQQGKVVKFDFHGRPAEIKHGSVVLAAICSSTNTSNPSVMIGAGLVAKKACELGLEVKPWVKTSLTPGSVVATEYLKHSGLQDYLNQQGFHVAAHGCATCVGNSGDLDGSVSAAITENDMVAAAVLSANRNFEGRVNPLTRANYLASPPLVVAYALAGTVDIDFEKEPIGVGKGGKEVFLRDIWPSNQEIDEVVESSVQTHLFKKVYDSIMERNPRWNQLPVPKEALYPWEDRSTYIRKPTYLEGMSMTPPAAPPTVTEAYCLLNLGDSITTDHISYSGKIPEGTPAAKYLLEYGVEPKNFSSYGGRRGNNEVVMRGAFANMRIVNKLLDGKAGPWTIHVPTGEKLYVYDAAMKYKSEGHDMVIIAGSEYGSGSSRDSAAKGPMLLGVKSVIAKSFERIHRSNLVGMGIIPLCFKAGEDADSLGLTGRERYTIHLPTSTAELSPGQDVTVTTHDGRSFTCTLRLDTQLEVTYFNHGGILPYMVRNLAAQMK

SEQ ID NO: 3006 - protein, 996 aa, Sorghum bicolor
MYKAANARLLLRSLSSNSAASASVPVNNPRLAAASSSSSAARLALSLPCGAWVGRSSGLVRAAGWSGTRPRFAGARAQIGAAAVPAVERFQRRMATQATEHAFKDILTSLPKPGGGEYGKFYSLPALNDPRIDKLPYSIRILLESAIRNCDNFQVTKNDVEKIIDWENTSPKLAEIPFKPARVLLQDFTGVPAVVDLAAMRDAMAKLGSDANKINPLVPVDLVIDHSVQVDVARSQNAVQANMELEFSRNKERFGFLKWGSSAFQNMLVVPPGSGIVHQVNLEYLGRVVFNTDGILYPDSVVGTDSHTTMIDGLGVAGWGVGGIEAEATMLGQPMSMVLPGVVGFKLTGKLRSGVTATDLVLTVTQMLRKHGVVGKFVEFYGEGMGKLSLADRATIANMSPEYGATMGFFPVDHVTLDYLKLTGRSDETVSMIEAYLRANKMFVDYNEPPTERIYSSYLELDLDEVEPSMSGPKRPHDRVPLKEMKSDWHACLDNKVGFKGFAVPKEQQDKVVKFDFHGQPAEMKHGSVVIAAITSCTNTSNPSVMLGAGLVAKKACELGLEVKPWVKTSLAPGSGVVTKYLLQSGLQEYLNQQGFHIVGYGCTTCIGNSGDLDESVSAAITENDVVAAAVLSGNRNFEGRVHPLTRANYLASPPLVVAYALAGTVDIDFEKEPIGLGKDGKEVYFRDIWPSTEEIAQVVQSSVLPDMFKGTYEAITKGNPMWNQLTVPEASLYSWDSKSTYIHEPPYFKDMTMSPPGPSAVKDAYCLLNFGDSITTDHISPAGSIHKDSPAAKYLMERGVDRKDFNSYGSRRGNDEIMARGTFANIRIVNKFLNGEVGPKTIHVPTGEKLYVFDAAMRYKSEGHATIILAGAEYGSGSSRDWAAKGPMLLGVKAVIAKSFERIHRSNLVGMGIIPLCFKAGEDADSLGLTGHERYSIDLPANLSEIRPGQDVTVITDNGKSFTCTLRFDTEVELAYFNHGGILPYVIRNLAGAQN

SEQ ID NO: 3007 - protein, 898 aa, Oryza sativa Japonica Group
MAAEHPFKNILTTLPKPGGGEYGKFYSLPALNDPRIDKLPYSIRILLESAIRNCDNFQVNQNDVEKIIDWENTSPKLAEIPFKPARVLLQDFTGVPAVVDLAAMRDAMAKLGSDANKINPLVPVDLVIDHSVQVDVARSPNAVQSNMELEFKRNNERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLQNGVTATDLVLTVTQMLRKHGVVGKFVEFYGEGMGKLSLADRATIANMSPEYGATMGFFPVDHVTLDYLKLTGRSDETVAMIEAYLRANKMFVDYNEPQTERVYSSYLELDLNEVEPCISGPKRPHDRVLLKEMKSDWHSCLDNRVGFKGFAVPKEQQDKVVKFDFHGQPAELKHGSVVIAAITSCTNTSNPSVMLGAALVAKKACELGLEVKPWVKTSLAPGSGVVTKYLLQSGLQEYLNKQGFHVVGYGCTTCIGNSGDLDESVSAAISENDVVAAAVLSGNRNFEGRVHPLTRANYLASPPLVVAYALAGTVDIDFEKEPIGVGKDGKEVFFRDIWPSTEEIAEVVQSSVLPDMFKSTYEAITKGNPMWNQLTVPEASLYSWDPNSTYIHEPPYFKDMTMSPPGPHGVKNAYCLLNFGDSITTDHISPAGSIHKDSPAAKYLLERGVDRKDFNSYGSRRGNDEVMARGTFANIRIVNKFLNGEVGPKTVHVPTGEKLYVFDAALKYKSEGHDTIVLAGAEYGSGSSRDWAAKGPMLLGVKAVIAKSFERIHRSNLVGMGIIPLCFKAGEDADSLGLTGHERYTIDLPTNVSEIRPGQDITVTTDNGKSFTCTLRFDTEVELAYFNHGGILPYVIRNLAQN

SEQ ID NO: 3008 - protein, 984 aa, Hordeum vulgare subsp. vulgare
MKLLPPPPAYSCSSSAPDPSARHRLRLPPPPQLPRASFPPPASRPFAGPRRAARLRCSPSSAAVRGRGSVAPAAQRSQQRRMAASGTEHAYSNILTSLPKPGGGEYGKFYSLPALNDPRIDKLPYSIRILLESAIRNCDGFQVTKNDVEKIVDWENTSPKLAEIPFKPARVLLQDFTGVPAVVDLAAMRDALAKLGSDANKINPLVPVDLVIDHSVQVDVARSTNALQSNMELEFTRNRERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLRNGVTATDLVLTVTQMLRKHGVVGKFVEFHGEGMGKLSLADRATIANMSPEYGATMGFFPVDHVTLDYLRLTGRSDETVSMIEAYLRANNMFVDYNEPQAERVYSSNLALDLDDVEPCISGPKRPHDRVTLKEMKSDWHACLDNKVGFKGFAVPKEQQDKVVKFDFHGQPAELKHGSVVIAAITSCTNTSNPSVMLGAALVAKKACELGLEVKPWVKTSLAPGSGVVTKYLLKSGLQEYFNKQGFHLVGYGCTTCIGNSGDLDESVSAVITENDVVAAAVLSGNRNFEGRVHPLTRANYLASPPLVVAYALAGTVDIDFEKEPIGVGKDGKEVYFRDIWPTTEEIAEVVQSSVLPDMFRSTYEAITKGNPMWNQLPVPEASLYSWDSNSTYIHEPPYFKDMTMSPPGPHAVKNAYCLLNFGDSITTDHISPAGSIHRDSPAAKYLLERGVDRKDFNSYGSRRGNDEVMARGTFANIRIVNKFLGGEVGPKTIHVPTGEKLSVFDAALKYKSEGHDTIILAGAEYGSGSSRDWAAKGPMLLGVKAVIAKSFERIHRSNLVGMGIIPMCFKAGEDADSLGLTGHERYTINLPTDVGQIRPGQDVTITTEDGKSFTCILRFDTEVELAYYNHGGILPYVIRNMAGAQK

SEQ ID NO: 3009 - protein, 898 aa, Citrus clementina
MAPENAFKGILTSLPKPGGGEFGKFFSLPALNDPRIDRLPYSIRILLESAIRNCDNFQVTKDDVEKIIDWENTSPKQVEIPFKPARVLLQDFTGVPAAVDLACMRDAMKNLNSDPKKINPLVPVDLVVDHSVQVDVARSENAVQANMEFEFQRNQERFAFLKWGSSAFHNMPVVPPGSGIVHQVNLEYLGRVVFNTDGILYPDSVGGTDSHTTMIDGLGVAGWGVGGIEAEAAMLGQPMSMVLPGVVGFKLTGKLRDGVTATDLVLTVTQMLRKHGVVGKFVEFYGEGMGQLPLADRATIANMSPEYGATMGFFPVDHVTLQYLKLTGRSDETVSMIEEYLRANKMFVDYNKPEQERSYSSYLQLDLADVEPCISGPKRPHDRVPLKDMKADWHACLENQVGFKGFAVPKQEQDKVAKFSFHGQPAELKHGSVVIAAITSCTNTSNPSVMLGAGLVAKKACELGLEVKPWVKTSLAPGSGVVTKYLQQSGLQKYLNQQGFHIVGYGCTTCIGNSGDLDESVATAITENDIVAAAVLSGNRNFEGRVHPLTRANYLASPPLVVAYALAGTVDIDFEKEPIGTGKDGKGVYFKDIWPSNEEIAEVVQSSVLPDMFKSTYEAITKGNPMWNQLSVPTSMLYSWDPNSAYIHEPPYFKNMTMEPPGPHGVKDAYCLLNFGDSITTDHISPAGSIHKDSPAAKYLLERGVDRKDFNSYGSRRGNDEVMARGTFANIRIVNKLLNGEVGPKTVHIPTGEKLYVFDAAMRYKAAGHETIVLAGAEYGSGSSRDWAAKGPMLLGVKAVIAKSFERIHRSNLVGMGIIPLCFKPGEDADTLGLAGHERYTINLPNKVSEIRPGQDITVTTDTGKSFTCTVRFDTEVELAYFDHGGILPYVIRNLIKQ

SEQ ID NO: 3010 - protein, 883 aa, Litchi chinensis
KPGGGEFGKFYRLPALNDPRIDKLPYSIRILLESAIRNCDNFQVKKEDVEKIIDWENTSPKLVEIPFKPARVLLQDFTGVPAVVDLACMRDAMNKLGSDSNKINPLVPVDLVIDHSVQVDVTRSENAVQANMELEFQRNKERFAFLKWGSTAFHNMLVVPPGSGIVHQVNLEYLGRVVFNTDGILYPDSVVGTDSHTTMIDGLGVAGWGVGGIEAEAAMLGQPMSMVLPGVVGFKLSGKLHNGVTATDLVLTVTQMLRKHGVVGKFVEFYGDGMGELSLADRATIANMSPEYGATMGFFPVDHVTLQYLKLTGRSDETVSMIEGYLRANKMFVDYNEPQQERVYSSYLELNLAEVEPCISGPKRPHDRVPLKEMKADWHSCLDNKVGFKGFAVPKEAQEKVAKFSFHGQPAELKHGSVVIAAITSCTNTSNPSVMLGAGLVAKKACELGLQVKPWIKTSLAPGSGVVTKYLLQSGLQEYLNQQGFHIVGYGCTTCIGNSGELDESVASAISENDVVAAAVLSGNRNFEGRVHPLTRANYLASPPLVVAYALAGTVDIDFEKEPIGTGKDGKSVYLRDIWPSTEEIAEAVQSSVLPNMFRSTYEAITTGNPMWNHLSVPTDTLYSWDPNSTYIHEPPYFKNMTMDPPGTHGVKDAYCLLNFGDSITTDHISPAGSIHKDSPAARYLMERGVERKDFNSYGSRRGNDEVMARGTFANIRLVNKLLNGEVGPQTVHVPTGEKLFVFDAAQRYKDAGHDTIILAGAEYGSGSSRDWAAKGPMLLGVKAVIAKSFERIHRSNLVGMGIIPLCFKAGEDADTLGLTGHERYTIDLPNSISEIRPGQDVTVTTDTGKSFTCTVRFDTEVELAYFNHGGILPYVIRNLIEQ

SEQ ID NO: 3011 - protein, 997 aa, Ricinus communis
MYIMTASSTASSLLRASRARLLSSSSSSVISRTTPLPPPLPKFSVTNRSLSFSAAVRSLRCSVPRWSHGVDWRSPVSLRSQIRTASPVIERFQRKISTMAAEHPFKGIVTPLPKPGGGEFGKFYSLPALNDPRIDKLPYSIRILLESAIRNCDNFQVTKQDVEKIIDWENSAPKQVEIPFKPARVLLQDFTGVPAVVDLASMRDAMNKLGGDSNKINPLVPVDLVIDHSVQVDVTRSENAVQANMELEFQRNKERFAFLKWGSNAFQNMLVVPPGSGIVHQVNLEYLGRVVFNKDGILYPDSVVGTDSHTTMIDGLGVAGWGVGGIEAEAAMLGQPMSMVLPGVVGFKLSGKLHNGVTATDLVLTVTQMLRKHGVVGKFVEFYGEGMGELSLADRATIANMSPEYGATMGFFPVDHVTLQYLKLTGRSDETISMIESYLRANKMFVDYNEPQQERVYSSYLQLDLGEVEPCISGPKRPHDRVPLKEMKADWHSCLDNKVGFKGFAIPKEVQEKVAKFSFHGQPAELKHGSVVIAAITSCTNTSNPSVMLGAGLVAKKACELGLQVKPWIKTSLAPGSGVVTKYLLQSGLQKYLNQQGFHIVGYGCTTCIGNSGDLDESVASAISENDIVAAAVLSGNRNFEGRVHALTRANYLASPPLVVAYALAGTVDIDFDKEPIGTGKDGKDVYFRDIWPSTEEIAEAVQSSVLPHMFRSTYEAITKGNPMWNQLTVPATTSYSWDPNSTYIHDPPYFKSMTLNPPGAHGVKDAYCLLNFGDSITTDHISPAGSIHKDSPAAKFLLERGVDRQDFNSYGSRRGNDEVMARGTFANIRLVNKLLNGEVGPKTVHIPTGEKLYVFDAASRYMAAGHDTIVLAGAEYGSGSSRDWAAKGPMLLGVKAVIAKSFERIHRSNLVGMGIIPLCFKPGQDADTLGLSGHERYTIDLPSNISEIKPGQDVTVTTDNGKSFTCTARFDTEVELEYFNHGGILPYVIRNLMKTE

SEQ ID NO: 3012 - protein, 1009 aa, Vitis vinifera
MYMATSPYSSLALLRASRVRFAPSISRVSLSSSSSSSSPHPPCPSRIPASASSSSLPFSTISGGYRSLGFLSAFRSRRWSHGVDWRSPVSLRAQIRAAAPVIERFERKMATIASEHPFKGILTSVPKPGGGEFGKFYSLPALNDPRIDKLPYSIRILLESAIRNCDNFQVTKDDVEKIIDWENTSPKQVEIPFKPARVLLQDFTGVPAVVDLACMRDAMNNLGSDSNKINPLVPVDLVIDHSVQVDVTRSENAVQANMDLEFQRNKERFSFLKWGSTAFRNMLVVPPGSGIVHQVNLEYLGRVVFNNDGILYPDSVVGTDSHTTMIDGLGVAGWGVGGIEAEAAMLGQPMSMVLPGVVGFKLSGKLCSGVTATDLVLTVTQMLRKHGVVGKFVEFYGEGMGELSLADRATIANMSPEYGATMGFFPVDHVTLQYLKLTGRSDETVAMIEAYLRANRMFVDYNEPQVERFYSSYLQLNLEDVEPCMSGPKRPHDRVPLKEMKTDWKACLDNKVGFKGFAVPKEAQDKVAKFSFHGQPAELKHGSVVIAAITSCTNTSNPSVMLGAGLVAKKASELGLEVKPWIKTSLAPGSGVVTKYLLQSGLQKYLNQQGFHIVGYGCTTCIGNSGDLDESVASAISENDIIAAAVLSGNRNFEGRVHALTRANYLASPPLVVAYALAGTVDIDFEKEPIGTGKDGKDVYFKDIWPTSEEIAEVVQSSVLPEMFKSTYEAITKGNPIWNQLSVHSSSLYSWDPNSTYIHEPPYFKNMTMNPPGPHGVKDAYCLLNFGDSITTDHISPAGSIHKDSPAAKYLIERGVAPKDFNSYGSRRGNDEVMARGTFANIRIVNKLLNGEVGPKTIHIPTGEKLYVFDAAMRYKADGHDTIVLAGAEYGSGSSRDWAAKGPMLQGVKAVIAKSFERIHRSNLVGMGIIPLCFKAGEDADTLGLTGHERYNIDLPSKISEIRPGQDVTVTTDNGKSFTCTVRFDTEVELEYFNHGGILPYAIRNLINQ

SEQ ID NO: 3013 - protein, 898 aa, Cucurbita cv. Kurokawa Amakuri
MAAENPFKENLTSLPKPGGGEFGKYYSLPSLNDPRIDRLPYSIRILLESAIRNCDNFQVKKEDVEKIIDWENSSPKQVEIPFKPARVLLQDFTGVPAVVDLACMRDAMNKLGSDSNKINPLVPVDLVIDHSVQVDVARSENAVQANMELEFQRNKERFAFLKWGSNAFQNMLVVPPGSGIVHQVNLEYLGRVVFNTSGLLYPDSVVGTDSHTTMIDGLGVAGWGVGGIEAEAAMLGQPMSMVLPGVVGFKLSGKLRNGVTATDLVLTVTQMLRKHGVVGKFVEFYGDGMEELSLADRATIANMSPEYGATMGFFPVDHVTLQYLKLTGRSDETVSMIEAYLRANKMFVDYKEPQQEKVYSSYLQLDLTDVEPCISGPKRPHDRVPLKEMKSDWHACLDNKVGFKGFAIPKEAQENVAKFSFHGQPAELKHGSVVIAAITSCTNTSNPSVMLGAALVAKKACELGLQVKPWVKTSLAPGSGVVTKYLLKSGLQPYLNQQGFHIVGYGCTTCIGNSGDLDESVSAAISDNDIVAAAVLSGNRNFEGRVHPLTRANYLASPPLVVAYALAGTVDIDFEKEPIGKGKDGKDVYFRDIWPSTEEIAEVVQSSVLPDMFKSTYESITKGNPMWNQLSVPSGTLYSWDPNSTYIHEPPYFKNMTMDPPGAHGVKDAYCLLNFGDSITTDHISPAGSIHKDSPAAKYLLERGVDRKDFNSYGSRRGNDEVMARGTFANIRLVNKLLDGEVGPKTVHVPTGEKLSVFEAAEKYKSAGQDTIVLAGAEYGSGSSRDWAAKGPMLLGVKAVIAKSFERIHRSNLVGMGIIPLCFKSGEDADSLGLTGHERYTIDLPDDISKIRPGQDVTVTTDSGKSFTCTVRFDTEVELAYFNNGGILPYVIRNLIKQ

SEQ ID NO: 3014 - protein, 898 aa, Citrus clementina
MAAEHPFKEILTALPKPGGGEFGKFYSLPALNDPRIEKLPYSIRILLESAIRNCDNFQVKKEDIEKIIDWENSAPKQVEIPFKPARVLLQDFTGVPAVVDLACMRDAMNKLGSDSNKINPLVPVDLVIDHSVQVDVTRSENAVKANMEFEFQRNKERFAFLKWGSSAFHNMLVVPPGSGIVHQVNLEYLGRVVFNTNGMLYPDSVVGTDSHTTMIDGLGVAGWGVGGIEAEAAMLGQPMSMVLPGVVGFKLSGKLHNGVTATDLVLTVTQMLRKHGVVGKFVEFHGDGMGELSLADRATIANMSPEYGATMGFFPVDHVTLQYLKLTGRSDETLAMVEGYLRANKMFVDYNEPQQERVYSSYLELNLADVEPCISGPKRPHDRVPLKEMKADWHSCLDNKVGFKGFAVPKETQEKVVKFSFHGQPAELKHGSVVIAAITSCTNTSNPSVMLGAGLVAKKACELGLQVKPWVKTSLAPGSGVVTKYLLQSGLQKYLNEQGFHIVGYGCTTCIGNSGDLDESVASAITDNDIVAAAVLSGNRNFEGRVHPLTRANYLASPPLVVAYALAGTVDIDFDKEPIGTTKDGKSVYFKDIWPTTEEIAEVVQSSVLPDMFKSTYEAITKGNPTWNQLSVPASKLYSWDPNSTYIHEPPYFKDMTMDPPGAHGVKDAYCLLNFGDSITTDHISPAGSIHKDSPTAKYLLERGVERRDFNSYGSRRGNDEVMARGTFANIRLVNKLLNGEVGPKTVHVPTGEKLSVFDAAMKYKSAGHGTIILAGAEYGSGSSRDWAAKGPMLLGVKAVIAKSFERIHRSNLVGMGIIPLCFKAGEDADSLGLTGHERFSIDLPSKISEIRPGQDVTVTTDSGKSFTCTVRFDTEVELAYFDHGGILPFVIRNLIKQ

SEQ ID NO: 3015 - protein, 583 aa, Sorghum bicolor; identical to SEQ ID NO: 2988

SEQ ID NO: 3016 - protein, 546 aa, Zea mays; identical to SEQ ID NO: 2987

SEQ ID NO: 3017 - protein, 582 aa, Hordeum vulgare subsp. vulgare; identical to SEQ ID NO: 2989

SEQ ID NO: 3018 - protein, 592 aa, Oryza sativa Japonica Group; identical to SEQ ID NO: 2990

SEQ ID NO: 3019 - protein, 592 aa, Oryza sativa Indica Group; identical to SEQ ID NO: 2991

SEQ ID NO: 3020 - protein, 108 aa, Sorghum bicolor
PSRYLFAIGLSPVFSLGRSLPPDLGCIPKQPDSLTAPRGAAGSGPDGALTLPGVPFQGTWARSVAEDASPDYNSGDEATRFSSWAGPGSLAVTRGILVSFFSSAYLYA

SEQ ID NO: 3021 - protein, 102 aa, Sorghum bicolor
AIGLSPVFSLGRSLPPDLGCIPKQPDSLTAPRGAAGSGPDGALTLPGVPFQGTWARSVAEDASPDYNSGDEATRFSSWAGPGSLAVTRGILVSFFSSAYLYA

SEQ ID NO: 3022 - protein, 91 aa, Sorghum bicolor
RSLPPDLGCIPKQPDSLTAPRGAAGSGPDGALTLPGVPFQGTWARSVAEDASPDYNSGDEATRFSSWAGPGSLAVTRGILVSFFSSAYLYA

SEQ ID NO: 3023 - protein, 91 aa, Sorghum bicolor
RSLPPDLGCIPKQPDSLMVPRGAAVSGPDGALTLPGVPFQGTWAQSVAEDASPDYNSGDEATRFSSWAGPGSLAVTRGILVSFFSSSYLYA

SEQ ID NO: 3024 - protein, 91 aa, Sorghum bicolor
RSLPPDLGCIPKQPDSLTAPHGAAGCGPDGALTLPGVPCQGTWARSVAEDASPDYNSGDEATRFSRWAGPGSLDVTREILVSFFSSAYLYA

SEQ ID NO: 3025 - protein, 368 aa, Sorghum bicolor
MVMGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQLSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 3026 - protein, 368 aa, Zea mays
MVMGASGSKLEKALGDQFPEGERYFGLENFGNTCYCNSVLQALYFCIPFREQLLEYYANNKTPGDVEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 3027 - protein, 368 aa, Zea mays
MVMGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKSFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNSSDDVDTEYSLFAVVVHVGSGPNHGHYVSLVKSHNHWLFFDDENVEMVEEQTLQTFFGTSHEYSGNTDHGYILFYEGLGGKS

SEQ ID NO: 3028 - protein, 368 aa, Zea mays
MVMGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKSFQGILTNETRCLRCETVTARDETFLDLSVDIEQNSSITSCLKNFCSTETLNAEDKFFCDKCCSLQEAQKRMKIKKTPHILVIHLKRFKYIEQLGRYKKLSYRVVFPMELKLSNSSDDVDTEYSLFAVVVHVGSGPNHGHYVSLVKSHNHWLFFDDENVEMVEEQTLQTFFGTSHEYSGNTDHGYILFYEGLGGKS

SEQ ID NO: 3029 - protein, 367 aa, Oryza sativa Japonica Group
MVMGASGSKLEKALGDQFPEGERYFGLENFGNTCYCNSVLQALYFCIPFREKLLEYYANNKTPGDAEENLLTCLADLFMQVSQSKKKTGVIAPKRFVQRVKKQNELFRSYMHQDAHEFLNFLLNELVDILEKESNAAKDSPQSSSPEKVPNGPVQPLANGVRKEPPVTLVHKNFQGILTNETRCLRCETVTARDETFFDLSVDIEQNSSITSCLKNFCSTETLNAEDKFFCDKCCSLQEAQKRMKIKKAPHILVIHLKRFKYIEQLGRYKKLSYRVVFPMELKLSTSDDVDTEYSLFAVVVHVGSGPNHGHYVSLVKSHNHWLFFDDENVEMVEESTLQTFFGSSHEYSGNTDHGYILFYEGLGGKS

SEQ ID NO: 3030 - protein, 370 aa, Hordeum vulgare subsp. vulgare
MVMGASGSKLEKALGDQFPEGERYFGLENFGNTCYCNSVLQALYFCTPFREQLLEYYTNNKNPGDAEENLLTCLADLFMQVSQSKKKTGVIAPKRFVQRVKKQNELFRSYMHQDAHEFLNFLLNELVDILEKESSAAKDSPQSSSPEKVPNGPVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKMGSTSDDVDTEYSLFAVVVHVGSGPNHGHYVSLVKSHNHWLFFDDENVEMVEESTLQTFFGSSHEYSGNTDHGYILFYEGLGGKSLG

SEQ ID NO: 3031 - protein, 365 aa, Oryza sativa Japonica Group
MGASGSKLEKALGDQFPEGERYFGLENFGNTCYCNSVLQALYFCIPFREKLLEYYANNKTPGDAEENLLTCLADLFMQVSQSKKKTGVIAPKRFVQRVKKQNELFRSYMHQDAHEFLNFLLNELVDILEKESNAAKDSPQSSSPEKVPNGPVQPLANGVRKEPPVTLVHKNFQGILTNETRCLRCETVTARDETFFDLSVDIEQNSSITSCLKNFCSTETLNAEDKFFCDKCCSLQEAQKRMKIKKAPHILVIHLKRFKYIEQLGRYKKLSYRVVFPMELKLSTSDDVDTEYSLFAVVVHVGSGPNHGHYVSLVKSHNHWLFFDDENVEMVEESTLQTFFGSSHEYSGNTDHGYILFYEGLGGKS

SEQ ID NO: 3032 - protein, 369 aa, Vitis vinifera
MGAAGSKLEKALGDQFPEGERYFGLENFGNTCYCNSVLQALYFCVPFREQLLEYYTNNKNLADAEENLLTCLADLFMQISSQKKKTGVIAPKRFVQRLKKQNELFRSYMHQDAHEFLNFLLNELVDILEKEASASKSDPETSSPPEKTANGPKTAQANGVQKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESSVQTFFGSAQEYSSNTDHGYILFYESLATNDKS

SEQ ID NO: 3033 - protein, 369 aa, Ricinus communis
MGAAGSKLEKALGDQFPEGERYFGLENFGNTCYCNSVLQALYFCVPFREQLLEYYANNKSGGDAEENLLTCLADLFTQISSQKKKTGVIAPKRFVQRLKKQNELFRSYMHQDAHEFLNFLLNELVDILEKEAQAAKSDPETSSSPEKIPNGPKNGQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLSRYKKLSYRVVFPLELKLSNTVEDSDIEYSLFAVVVHVGSGPNHGHYVSLVKSHNHWLFFDDENVEMIDESAVQTFFGSSQEYSSNTDHGYILFYESLGASNKS

SEQ ID NO: 3034 - protein, 366 aa, Vitis vinifera
MGAAGSKLEKALGDQFPEGERYFGLENFGNTCYCNSALYFCVPFREQLLEYYTNNKNLADAEENLLTCLADLFMQISSQKKKTGVIAPKRFVQRLKKQNELFRSYMHQDAHEFLNFLLNELVDILEKEASASKSDPETSSPPEKTANGPKTAQANGVQKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESSVQTFFGSAQEYSSNTDHGYILFYESLATNDKS

SEQ ID NO: 3035 - protein, 395 aa, Sorghum bicolor
MDAPLLVTFLVVVPVAVVVALLVASASAAAPRAFFVFGDSLVDNGNNNYLMTTARADAPPYGIDFPTHMPTGRFSNGLNIPDIISEHLGSQPALPYLSPDLRGDQLLVGANFASAGVGILNDTGIQFVNIIRIGQQLQNFQDYQQRLAEFVGEDAARQVVNNALVLITLGGNDFVNNYYLVPFSVRSRQFAIQDYVPYLISEYRKILTRLYELGARRVVVTGTGMIGCVPAELAMHSIDGECARDLTEAADLFNPQLVQMLSQLNADIGGDVFIAANTNRVSFDFMFNPQDYGFVTSKVACCGQGPYNGIGLCTPASNVCPNRDVYAYWDAFHPTERANRIIVGQFMHGSTDHITPMNISTILAMDNTQQGLGLPAAAAAASLHPISPWLADVHP

SEQ ID NO: 3036 - protein, 367 aa, Zea mays
MDALLVTTFLVPVVALLLGSGSGSAAPLPRAFFVFGDSLVDNGNNNYLMTTARADAPPYGIDFPTHMATGRFSNGLNIPDIISEHLGSQPALPYLSPDLRGAQLLVGANFASAGVGILNDTGIQFVNIIRIGQQLRNFQEYQQRLAAFVGEDAARQAVSDALVLITLGGNDFVNNYYLVPFSVRSRQFAIQDYVPYLISEYRKILTRLYELGARRVVVTGTGMIGCVPAELAMHSVDGECARDLTEAADLFNPQLVQMLSELNADIGADVFIAANTNRVSFDFMFNPQDYGFVTSKVACCGQGPYNGIGLCTPASNVCPNRDVYAYWDAFHPTERANRIIVGQFMHGSTDHISPMNISTILAMDNRN

SEQ ID NO: 3037 - protein, 369 aa, Zea mays
MDAALLVTVLVPAVAALLVLGSGAASASPPRAFFVFGDSLVDNGNNNYLMTTARADAPPYGIDFPTHLPTGRFSNGLNIPDIISEHLGSQPALPYLSPDLRGDQLLVGANFASAGVGILNDTGIQFVNIIGIGQQLHNFQDYQQRLAAFVGDDAARQVVSNALVLITLGGNDFVNNYYLVPFSFRSRQFAIQDYVPYLISEYRKILTRLYELGARRVVVTGTGMIGCVPAELAMHSIDGECARDLTEAADLFNPQLVQMLSDLNAAIGGDVFIAANTNRLSFDFMFNPQDYGFVTAKVACCGQGPYNGIGLCTPASNVCPNRDVYAYWDAFHPTERANRIIVAQFMHGSTDHISPMNISTILAMDNRGD

SEQ ID NO: 3038 - protein, 367 aa, Zea mays
MDAALLVTVLVPAVAALLVLGAASASPPRAFFVFGDSLVDNGNNNYLMTTARADAPPYGIDFPTHLPTGRFSNGLNIPDIISEHLGSQPALPYLSPDLRGDQLLVGANFASAGVGILNDTGIQFVNIIGIGQQLHNFQDYQQRLAAFVGDDAARQVVSNALVLITLGGNDFVNNYYLVPFSFRSRQFAIQDYVPYLISEYRKILTRLYELGARRVVVTGTGMIGCAPAELAMHSIDGECARDLTEAADLFNPQLVQMLSDLNAAIGGDVFIAANTNRLSFDFMFNPQDYGFVTAKVACCGQGPYNGIGLCTPASNVCPNRDVYAYWDAFHPTERANRIIVAQFMHGSTDHISPMNISTILAMDNRGD

SEQ ID NO: 3039 - protein, 369 aa, Zea mays
MDALLVTTTFLVPVVALLLGSGSGSAAALPRAFFVFGDSLVDNGNNNYLMTTARADAPPYGIDFPTHMATGRFSNGLNIPDIISEHLGSQPALPYLSPDLRGAQLLVGANFASAGVGILNDTGIQFVNIIRIGQQLRNFQEYQQRLAAFVGDEDAARQAVSDALVLITLGGNDFVNNYYLVPFSVRSRQFAIQDYVPYLISEYRKILTRLYELGARRVVVTGTGMIGCVPAELAMHSVDGECARDLTEAADLFNPQLVQMLSELNADIGADVFIAANTNRVSFDFMFNPQDYGFVTSKVACCGQGPYNGIGLCTPASNVCPNRDVYAYWDAFHPTERANRIIVGQFMHGSTDHISPMNISTILAMDNRN

SEQ ID NO: 3040 - protein, 368 aa, Oryza sativa Japonica Group
MGASSLVGFLMAAVAALLVAAATPAAAAPRAFFVFGDSLVDNGNNNYLMTTARADAPPYGIDFPTHMPTGRFSNGLNIPDIISEYLGSQPALPYLSPDLRGENLLVGANFASAGVGILNDTGIQFVNIIRIGQQLDNFENYQRNLAAFVGEDAARQVVQQSLVLITLGGNDFVNNYYLVPFSVRSRQFAIQDYVPYLISEYRKILTRLHDLGPRRVIVTGTGMIGCVPAELAMHSIDGECATDLTRAADLFNPQLERMLAELNSELGGHVFIAANTNKISFDFMFNPQDYGFVTAKVACCGQGPYNGIGLCTPASNVCANRDVYAYWDAFHPTERANRLIVAQIMHGSTDHISPMNLSTILAMDERRN

SEQ ID NO: 3041 - protein, 368 aa, Hordeum vulgare subsp. vulgare
MDACSQALAVVAALLLLVGASAPTASAARAFFVFGDSLVDNGNNNYLMTTARADAPPYGIDFPTHMPTGRFSNGLNIPDIISEYLGAEPALPYLSPYMRGDNLLVGANFASAGVGILNDTGVQFVNIIRIAQQLQNFQDYQRRLAAYIGEDAARQRVSQSLVLITLGGNDFVNNYYLVPFSARSQQFEIHDYVPFIVSEYKKVLARLYELGARRVIVTGTGMIGCVPAELALHSLDGSCAPDLTRAADLFNPQLERMLTELNGEVGHDDVFIAANTNRVSFDFMFNPQQYGFATAKIACCGQGPYNGIGLCTPASNVCANRDAYAYWDAFHPTERANRIIVANFMHGTTDHISPMNLSTILAMDNTRN

SEQ ID NO: 3042 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQDVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 3043 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 3044 - protein, 240 aa, Oryza sativa Japonica Group
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 3045 - protein, 235 aa, Oryza sativa Indica Group
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLG

SEQ ID NO: 3046 - protein, 240 aa, Hordeum vulgare subsp. vulgare
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLMGQDLSGMGVKELQTLENQLEISLRCIRTKKDQILIDEIHELNHKGSLVHQENMELYKKINLIRQENVELHKKLSETEAATEVNRDSRTPYNFAVVEDANVSVNLELNSPQQQNDVEHTAPPKLGLQLHP

SEQ ID NO: 3047 - protein, 240 aa, Triticum aestivum
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLMGQDLSGMGVKELQALENQLEISLRCIRTKKDQILIDEIHELNHKGSLVHQENMELYKKINLIRQENVELQKKLSETEAVTEVNRNSRTPYNFAVVEDANVSVDLELNSPQQQNDVEHTAPPKLGLQLHP

SEQ ID NO: 3048 - protein, 235 aa, Oryza sativa Japonica Group
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 3049 - protein, 236 aa, Oryza sativa Japonica Group
MGRGKIVIRRIDNSTSRQVTFSKRRNGIFKKAKELAILCDAEVGLMIFSSTGRLYEYSSTSMKSVIDRYGKSKDEQQAVANPNSELKVLAKGGSKLETTTAQLARKSSVWLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLG

SEQ ID NO: 3050 - protein, 240 aa, Oryza sativa Japonica Group; identical to SEQ ID NO: 3044

SEQ ID NO: 3051 - protein, 235 aa, Oryza sativa Indica Group; identical to SEQ ID NO: 3045

SEQ ID NO: 3052 - protein, 236 aa, Oryza sativa Japonica Group; identical to SEQ ID NO: 3049

SEQ ID NO: 3053 - protein, 240 aa, Zea mays; identical to SEQ ID NO: 3043

SEQ ID NO: 3054 - protein, 240 aa, Zea mays; identical to SEQ ID NO: 3042

SEQ ID NO: 3055 - protein, 240 aa, Hordeum vulgare subsp. vulgare; identical to SEQ ID NO: 3046

SEQ ID NO: 3056 - protein, 235 aa, Oryza sativa Japonica Group; identical to SEQ ID NO: 3048

SEQ ID NO: 3057 - protein, 240 aa, Triticum aestivum; identical to SEQ ID NO: 3047

SEQ ID NO: 3058 - protein, 367 aa, Zea mays; identical to SEQ ID NO: 3038

SEQ ID NO: 3059 - protein, 369 aa, Zea mays; identical to SEQ ID NO: 3037

SEQ ID NO: 3060 - protein, 367 aa, Zea mays; identical to SEQ ID NO: 3036

SEQ ID NO: 3061 - protein, 369 aa, Zea mays; identical to SEQ ID NO: 3039

SEQ ID NO: 3062 - protein, 395 aa, Sorghum bicolor; identical to SEQ ID NO: 3035

SEQ ID NO: 3063 - protein, 368 aa, Oryza sativa Japonica Group; identical to SEQ ID NO: 3040

SEQ ID NO: 3064 - protein, 368 aa, Hordeum vulgare subsp. vulgare; identical to SEQ ID NO: 3041

SEQ ID NO: 3065 - protein, 176 aa, Zea mays
METTEGSCKESPVAQTVAVEGRDRESDRKNREHLCAEALSQLPGSKIDGEYDPLMLDLFVYRRAVAPRDTAWESAPLVLHDEGLITVRVGWPPHEPEQPWDLVEAMTRILGHHPGPVSSFRLHSSLSPDVDTLGCWMDLLSEKGVAELIIFNLYQDVSTAQLPLQRLTSYHQCARM

SEQ ID NO: 3066 - protein, 176 aa, Zea mays
METTEGSYKESPVAQTVAVEGGDRESDRKNREHLCAEALSQLPGSKIDGEYDPLMLDLFVYRRAVAPRDTAWESAPLVLHDERLITVRVGWPPHEPEQPRDLVEAVTRILGHHPGPVSSFRLHSSLSPGVDTLGCWMDLLSEKGVAELIIFNLYQDVSTAQLPLQRLTSYHQCARM

SEQ ID NO: 3067 - protein, 106 aa, Zea mays
MDTSSPAALVNAKIMNMFVGQRVRTVVQVQHNDGGMLVGQSPDGHQLSIKSAMDVPVSHFMEVYGIAENSQTIRAEVCTDFGPDFDPETFNQLCNLASNKFKHMFL

SEQ ID NO: 3068 - protein, 106 aa, Zea mays
MDTSSPAALVNAQMLNMFVGRRVRTVVQVQHNEGGVLVGQSTDGHQLCVKSAMDVPVSHFMEVYGIAENSQTIRAEVCTDFGPNFDPKVFDELCKLASGRFKHLFL

SEQ ID NO: 3069 - protein, 88 aa, Sorghum bicolor
MDTSSPAALVNAETLNMFVGRRVRTVVQVQRNEGGVVVGQSSDGHQLSIKSAMDVPVSNFMEVYGIAENNQTIRAEVCTDFGPNFDPP

SEQ ID NO: 3070 - protein, 378 aa, Sorghum bicolor
MTLLAAITNPAAGSLPGSSEKAHPIVLTPGAAPPPPTSSALPTPIPPSAWSLSPADRTFATAASYLATSLDSCSSLPRLRLLLTNFVATLSQSLALPTPPPAIPAAIRAVAPYFPAAIASLVASKAASLAEHDILLALAESRLLRHPPPELISSLCDNDRVDLVCALLRQAADIRSSEILAALRCFLSPASEKAYDAMMDVKGRWKDAAVLAVNRCREKSAGKKKNADAAARRAALLLMMGHDGFTSPEVCLHYLFASGNVDSVVLGAAVAELDGGEVVRLMRYLNKWIGKYRRFSEARTCPEAVENLGLEQCQSVPSFGAVARALGVLLDNHFSHLVLNADVREDLRAAELMVRELAAEAESSGPILDLLHRLQLDK

SEQ ID NO: 3071 - protein, 378 aa, Zea mays
MTLLAAITNPAADSRSGSSERAHPIVLTPGVTPPPPPSSTLPTPIPSSTWSLSPADPTLATAASYLAASLASCSSLPQLRALLTTFITTLSRSLALPTPPAALPAAIRAVAPYFPAAIASLVASKAVSLAGHDILLALAESRLLPHPPPELISSLCDNDWVDLVCVLLRQAADIRSSEILAALRCFLSPASDKAYDAMMDVKCRWKDAAVLAVNRCREKSAVKRKKVDAAARLAALLLMMGHDGFTSPEVCLHYLFASGNVDSVVLGAALAELDGGEVVRLMRYLNKWIRKYWSFSEAHTCPEAVENLRLEQCDSVPSFGAVARALGVLLDNHFSHLVLNADVREDLRAADLMVRELAAEAESSGPIPDLLHRFQLDK

SEQ ID NO: 3072 - protein, 378 aa, Zea mays
MTLLAAITNPAADSRSGSSERAHPIVLTPGVPPPPPPSSTLPTPIPPSTWSLSPADPTLATAASYLAASLASCSSLPHLRALLTTFITTLSQSLALPTPPAALPAAIRAVAPYFPAAIASLVASKAVSLAGHDILLALAESRLLPHPPPELISSLCDNDRVDLVCILLRQAADIRSSEILAALHCFLSPASDKAYDAMMDVKCRWKDAAVLAVNRCREKSAVKRKKADAAARHAALLLMMGHDGFTSPEVCLHYLFASGNVDSVVLGAALVELDGGEVVRLMRYLNKWIRKYWSFSEAHTCPEAVGNLRLEQCDSVPSFGAVARALGVLLDNHFSHLVLNADVREDLRAADLMVRELAAEAESSGPILDLLHRFQLDK

SEQ ID NO: 3073 - protein, 378 aa, Zea mays
MGKDDVIESGAGGGEFAAKDYTDPIVLTPGVTPPPPPSSTLPTPIPSSTWSLSPADPTLATAASYLAASLASCSSLPQLRALLTTFITTLSRSLALPTPPAALPAAIRAVAPYFPAAIASLVASKAVSLAGHDILLALAESRLLPHPPPELISSLCDNDWVDLVCVLLRQAADIRSSEILAALRCFLSPASDKAYDAMMDVKCRWKDAAVLAVNRCREKSAVKRKKVDAAARLAALLLMMGHDGFTSPEVCLHYLFASGNVDSVVLGAALAELDGGEVVRLMRYLNKWIRKYWSFSEAHTCPEAVENLRLEQCDSVPSFGAVARALGVLLDNHFSHLVLNADVREDLRAADLMVRELAAEAESSGPILDLLHRFQLDK

SEQ ID NO: 3074 - protein, 376 aa, Oryza sativa Japonica Group
MTLLAAITNPSAAAAAAAVAANPIVLTPGAAPPPPTSSALPTQIPPSDWSLSPADPALATAASFLSTSLSSTSVSLPRFRSLLASFLTTLSNSLSLPAPSPNLPQAIRSVSPYFPAALASPVASRAASLAEYDVLLALAECGLLRHPPPSLLSSLSEADRPELVCAVVRQAADLRSSELLATLRCFLSPASDAAYDAMMSVKNRWKEAAVLAVNRCKEKGAGKKVDAMARQAALLLMMGYDGFTSPEVCLHYLFASENVDSVVFGAAVSELDGGEVVRLMKYLTKWIGKYQRFPEAQACPEAVGMPGLELCDIVPSFRVVAGALGLVFDQHFSHLALNAELKEDLKAAEMMVKQLATEAESAGPILDLLRRMQQDV

SEQ ID NO: 3075 - protein, 373 aa, Oryza sativa Indica Group
MTLLAAITNPSAAAAAAANPIVLTPGAAPPPPTSSAIPTQIPPSDWSLSPADPALATAASFLSTSLSSASVSLPRFRSLLASFLTTLSNSLSLPAPSPNLPQAIRSVAPYYPAALASPVASRAASLAEYDVLLALAECGLLRHPPPSLLSSLSEADRPDLVCAVVRQAADLRSSELLATLRFFLSPASDAAYDAMVSVKNRWKEAAVLAVNRCKEKGAGKKVDAMARQAALLLMMGYDGFTSPEVCLHYLFASENVDSVVFGAAVSELDGGEVVRLMKYLTKWIGKYQRFPEAQACPEAVGMPGLELCDIVPSFRVVAGALGLVFDQHFSHLALNAELKEDLKAAEMMVKQLATEAESAGPILDLLRRMQQDV

SEQ ID NO: 3076 - protein, 492 aa, Zea mays
MTLVRMPCRLCCFLLVVAASAVSGRGRVVTTLPGYEGRLPFHLETGYVEVDEDAGAELFYYFVRAESGADDSDTPFVLRIPGGQRCSAFSGLAYEIGPIMFVVEPYNGSLPRLRYNPNSWTKVAHILFVDSPVGAGFSFSRDAKGYNAGAVSTTMHLAKFLTKWFNDHPEYHANPFYIDGESYAGKIVPFLAQMISEGIEAGMKSAPRLKGYLVGNPSTEERIDVSARVPCAHGFGIISHQLYEMILGHCHGEDYSNPAKELCGQALKTFNNLTSEVAQGHVLQEKCVAASSSPVPNANSRVAGGSSSWASDGRKILREEEMVGRRGVVLGKLFHPPALPPFSCRVYRYYLSYFWANDRRTRDALGIKEGTVDEWVRCHNDDQELPYESELKSVVKYHRNLTSRGYRALVYSGDHDLLVPHLGTQAWVRSLNFPVVDDWRAWHLGGQSAGFTTTYSNNMTFATIKGAGHTAPEYEPERCFAMFSRWILNRPL

SEQ ID NO: 3077 - protein, 491 aa, Zea mays
MTLVRMPCRLCCFLLVVAASAVSGRGRVVTTLPGYEGRLPFHLETGYVEVDEDAGAELFYYFVRAESGADDSDTPFVLRIPGGQRCSAFSGLAYEIGPIMFVVEPYNGSLPRLRYNPNSWTKVAHILFVDSPVGAGFSFSRDAKGYNAGAVSTTLHLAKFLNKWFNDHPEYHANPFYIDGESYAGKIVPFLAQMISEGIGAGMKSAPRLKGYLVGNPSTEERIDVSARVPCAHGFGIISHQLYEMILGHCHGEDYSNPAKELCGQALKTFNDLTSEVAQGHVLQEKCVAASSSPVLNANSRVAGGSSSWASDGRKILREEEMVGRRGVLGKLFHPPALPPFSCRVYRYYLSYFWANDRRTRDALGIKEGTVDEWVRCHNDDQELPYESELKSVVKYHRNLTSRGYRAMVYSGDHDLLVPHLGTQAWVRSLNFPVVDDWRAWHLGGQSAGFTITYSNNMTFATIKGAGHTAPEYEPERCFAMFSRWILNRPL

SEQ ID NO: 3078 - protein, 483 aa, Sorghum bicolor
MTTAARPRRLLHPLGCLCFLVVAAFAASISSAAGRVVTSLPGFDGDLPFHLETGYVEVDEDAGVELFYYFVRSESESESGDAPFLFWLTGGDRCSVFSGLAYEIGPIRFVVEPYNGTLPRLRYNQNSWSKVSHILFVDSPVGAGFSFSRDPKGYDVGDISSTQQLRDFLIKWFDDHPEYLANPFYIGGDSYAGKIVPFIGQMISEGIEAGRRPFPNLKGYLVGNAATGESIDTTSRVPYAHGVGIISAQLYETILGHCQGEDYTNPANTLCAQALYTFNNLIDEVQHAHILLDRCVYASPAPNVVSRMDGSDNRRILRAEMGRGMLNHPPARPPFGCLTYRYYLSYFWANDKRTREALGIKKGTVDEWVRCHDGDLPYTKDLKSSIKYHRNLTSRGYRALVYSGDHDLLVPHLGTQAWVRSLNFPIVDDWRAWHLGGQAAGFTISYSNNMTFATIKGGGHTAPEYEPERCFAMFTRWILNNPL

SEQ ID NO: 3079 - protein, 491 aa, Zea mays; identical to SEQ ID NO: 3077

SEQ ID NO: 3080 - protein, 492 aa, Zea mays; identical to SEQ ID NO: 3076

SEQ ID NO: 3081 - protein, 483 aa, Sorghum bicolor; identical to SEQ ID NO: 3078

SEQ ID NO: 3082 - DNA, 1676 bp, Oryza sativa Japonica Group
cttcaggtggaagccacaaaacgaacgcgaactcgagcggcgaagaagaagagagagagagataaggcggcggcagcgagatggcggtgacgatccagtccgtgaaggcgaggcagatcttcgacagccgcgggaaccccacggtggaggtggacgtgggactcagcgatggcagcttcgcgaggggcgccgtgccgagcggtgcttccaccggaatatatgaggccttggagttaagagatggaggatccgactatcttggcaaaggtgtactcaaggctgtgagcaatgtaaacactattattgggccagcactcatcggaaaggatcccactgagcaagttgacattgataacttcatggttcaacagcttgatggaacctccaacaactggggctggtgcaaacaaaagcttggagcaaatgctattcttgctgtttcacttgctgtgtgcaaagcaggagccatggtgaagaagattcccctttaccagcacattgcaaatcttgctggaaacaagactctcgtgctgcctgtacccgctttcaatgtgatcaatggaggatcccatgctggaaacaaacttgccatgcaggagttcatgatcctccctactggtgcatcctctttcaaggaggccatgaagatgggagttgaggtgtaccaccacttgaagagtataatcaagaaaaagtatggccaagatgccacaaatgtgggggatgaaggtggctttgctcctaacattcaggaaaacaaagagggcctcgaactgttgaaggccgcaatagctaaggctggctacacaggcaaagtggtcataggaatggatgttgcagcttctgaattttacagtgaaaaggacaagacttacgatcttaacttcaaggaggataacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacaagggttgccaaggcaattagtgaaaagacttgcaatgctcttctcttgaaggtgaatcaaataggctcagttactgagagcattgaggctgttagaatgtccaagcgtgctggatggggagtgatggcaagccataggagtggtgagacagaggataccttcattgctgacctctcagttggtctgtctacgggtcaaattaagacaggagctccctgtcggtcagagcgtctggctaaatacaaccagctgctcaggatagaagaagagctgggcgatgctgcagtttacgctggagaaaaattcagagcccctgtggagccgtactaaaccttggcaccttgcggtgatcttgtgcctatggaccatggtgccatcaatctactactgcgtttttacacgagtctacaagggcaataaaattagtacttcttgacagtcccagaaattgcttagttaccctcgctttttcgttaatggccagattgtttgcttactactgtgttgacacacttgagcaccaatatgtaagatcaataaaagagcaaatcgcttgatttttcatcataaagtatttttttcccc

SEQ ID NO: 3083 - DNA, 1699 bp, Zea mays
acagcgcgcgcttcaaggcctttttttttgagataacaaggaggagaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaacaacattattggaccagcgattgttggaaaggaccccactgagcaggttgagattgacaacttcatggtccaacagcttgacggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgtcgtaatgtcgtttgcctaaactgattttgatggaacaggaaatcttgctggtcttgccaaaaaaaaaaaaaaaaaaaaaaaaaaaaaaaaaaaaaa

SEQ ID NO: 3084 - DNA, 1684 bp, Zea mays
caaaagcattgcgaccacagacagcgcgcgcttcaaggccttttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactgggatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactctggtgctccctgtacctgcctttaacgtgattaatggagggtcacatgctggaaacaagcttgccatgcaggagttcatgatcctcccaactggtgcctcctcgttcaaggaggccatgaagatgggagttgaggtgtaccacaacctgaagagcatcatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaacacttatgatcttaatttcaaggaggagaacaacgatggctcaaagaaaatttcaggcgacagcctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatgggaagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttcttctctctctctagattctgacgagtggtggtctgcactcgtcgtaatgtcgtttgcctaaactgattttgatggaacaggaaatcttgctggtcttgcca

SEQ ID NO: 3085 - DNA, 1566 bp, Zea mays
catcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 3086 - DNA, 1615 bp, Zea mays
tctcccaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgcttcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgtttaaaaaaaaaaaaaaaaaaaaagaaaaaaaaaaaaaaaa

SEQ ID NO: 3087 - DNA, 1686 bp, Populus trichocarpa
cagcatctctgtgactgtctcaggaaaaagaacagaaaagagaaacctcaggatcatcgaagtgttggaacatcagatcaacaatggtaacgatcaaggctgttaaagctcgtcaaatttttgacagtcgtggaaatcccaccgttgaagctgatattttgctctctgatggaagctatgctagagctgccgttccaagtggtgcttccactggtgtctatgaagctttagagttgagagatggaggatcagattatcttgggaaaggtgtacttaaggctgtagggaatgtcaattctatcattggaccagccttgattggcaaggacccaacagagcaggttcaaatcgataatttcatggtacaagagctggatggaactgttaatgaatggggttggtgcaagcagaagctcggagcaaatgctatattggcagtgtcacttgctgtttgcaaagcaggtgcaatggttaagaagatccctctttaccagcacattgcaaatcttgctggaaacaagaccttggttttgccagtacctgcattcaatgtcatcaatggaggttcccatgctggaaataaactggcaatgcaggaattcatgattctccctgttggggcatcatctttcaaggaagccatgaaaatgggtgtagaagtgtatcatcacctgaagtctgtgattaagaagaagtatggacaagatgccaccaatgttggtgatgaaggtggctttgctcctaatattcaggaaaacaaagagggtcttgaactgctcaagacagcgatagccaaagctggatatactggaaaggttgtgattgggatggatgttgctgcgtcagagttttataatgacaaggacaagacctatgatttgaatttcaaggaagagaacaatgatggatcacagaagatatctggagacagtctaaagaatgtatacaagtcatttgtggctgattatccaattgtgtccatcgaggatccatttgatcaagatgattgggaacactatgctaagatgactggtgaagttggtgaacaggtgcaaattgttggtgatgatctacttgtcacaaaccccaagcgtgtggagaaagcaattaaggagaagtcctgcaatgcccttctattgaaggtgaatcaaattggttctgtaactgaaagtattgaagctgtgaaaatgtctaaacatgctggctggggtgtcatggcaagccacagaagtggtgaaactgaggatactttcattgcagacctttcagttggattgtctactggacagatcaagactggagctccttgcagatcagaacgccttgcaaaatacaaccagcttctcaggatagaggaagagctgggatctgcagcagtatatgcaggagcaaaattcagggcaccagttgaaccttactaaagcgttaccagtcttactgagcaaaattcagtacctctaaataagctcttgagcttcgtgcttgtactttgcagcatattagtttttgcttggtagtgaaggatgtttttgccatcgcggctagttacttgcattacctgagggcgtgagttctggacgtttcccagtgctggtttttgttttgattgttattaataatatgcttgaactgtgagttatcacagaagttttgagtatgttcaagttctaacaacatattttccat

SEQ ID NO: 3088 - DNA, 1550 bp, Zea mays
gttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctcttactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaactgttacggacatgtacccaaacgtgatccagttttagttaatgtgccccatgcttgacgtttaaaaa

SEQ ID NO: 3089 - DNA, 1338 bp, Elaeis guineensis
atggcgacgatcaagtgcatcaaggcccgtcagatctttgatagccgtggcaatcccaccgtggaggtggattgttgtctcagtgatggaactttctccagggctgctgttccaagtggagcatcgacaggtatatatgaagctttggagctgagagatggaggatcagactaccttgggaaaggtgtccttaaggctgttacgaatgtgaactctatcatcggaccagcattgattgggaaggatccgaccgcacaggctgagatcgatactttcatggttcagcaacttgatgggacctctaatgagtggggttggtgcaaacaaaagctcggtgcaaatgccatattggcagtatctcttgctgtttgcaaagcaggtgctagtgtgaagaagattcctctttaccagcatattgccaatctggctggaaacaagaacttagtgttgcctgtacccgcattcaatgttattaatggtggatctcatgcgggaaacaaactcgcgatgcaggaatttatgatccttcctgttggggcatcctcattcaaggaagccatgaagatgggtgtagaagtataccatcatttgaaggctgtcattaagaaaaagtatggacaggatgctactaatgctggagatgaaggtggttttgctcctaacattcaggaaaacaaggaaggacttgagctgttgaagacagctatagcaaaagctggatatactggcaaagtggtgattgggatggatgttgctgcttcagagttctacagtgacaaggataagacatatgatttgaatttcaaggaggagaacaatgatggttcgcagaaaatatctggggatagtttgaaaaatgtttacaagtcctttgtcagcgggtatcccatcgtatcaatcgaagacccgtttgatcaggatgattggacccactatgcaaaaatgacagaggagattggagagcaggtgcagattgttggagacgatcttcttgtcaccaacccaacgcgtgttgccaaggcaattaaggaaaagacatgcaatgccctccttttgaaggtgaatcagatagggtctgtgactgagagcattgaagctgtaaaaatgtctaaacgtgctggctggggtgtaatgacaagccaccgaagtggtgaaacggaggatactttcattgctgaccttgcagttggtttggccacgggccaaatcaagaccggagctccatgccgttctgaacgccttgccaagtataatcagttgctcaggattgaggaggagcttggtgctgcagcagtctatgcaggagcaaagttccgtgctcctgtagagccttattag

SEQ ID NO: 3090 - DNA, 1722 bp, Hordeum vulgare subsp. vulgare
ggtacagccaaccgaacccccatccctctcgccctccgctccgattcgatccgcctcggcttcctctccaagccatggccgccgccgccgccacgatccagtccgtcaaggcccgccagatcttcgacagccgcggcaaccccaccgtcgaggtcgatgtgtgctgctccgatggaaccttcgccagggccgccgttcccagcggtgcatcgaccggtgtttatgaagctctggaactgagggacggcgggtctgactacttgggcaagggggtttccaaggctgttggcaatgtgaactccattattgcacccgctttgatcggcaaggaccctaccgctcaaactgagcttgacaactttatggttcagcagcttgatggaaccaagaatgagtggggttggtgcaagcaaaagcttggtgctaatgcgatcctggctgtctcgctagctgtttgcaaagctggagccagcgtcaagaagattccactgtaccagcacattgccaaccttgctggcaacaagcagttggttttgcctgttcctgcattcaatgtcatcaatggtggatcccatgctggaaacaagcttgctatgcaggagttcatgatccttcctactggagctgcctcgttcaaggaggcaatgaagatgggcgttgaagtgtaccacaacttgaagtctgttatcaagaagaagtatgggcaggatgccaccaatgtcggagatgaaggtggttttgctcctaacattcaggagaacaaggagggccttgagctcttgaagactgcaattgaaaaggctggatacaccggcaaggttgtcattggaatggatgtcgctgcttcagagttctacaatgacaaggacaaaacctatgacctcaacttcaaggaggagaacaacgatggttcgcagaagatatctggagatagcctgaagaacgtgtacaagtcatttgtgagcgagtaccccattgtgtcgattgaggacccatttgaccaggatgactgggttcactatgctaagatgactgaggaatgcggagagcaagttcagattgttggtgatgaccttctagtcaccaacccaaccagagttgcgaaggcaatccaggagaagtcatgcaatgctcttctgctgaaggttaaccaaattggatccgtcactgagagtatcgaagccgtgaagatgtcgaaacacgctggctggggtgtcatgaccagccacaggagtggtgagaccgaggacacattcattgctgatttggctgttggtctgtccacgggccagattaagactggggctccatgccgctcagagcgtcttgccaagtacaaccagcttctgaggatcgaggaggagctgggcgatgccgccgtgtacgccggcctcaagttccgcgcaccggtggagccctactaaaagggggacctgctccaggtttttgcgaaaaccggtgtgttttttaacctccggaatgtactcttgttgaagctcgtaggatttgaggaaataatgaatgtcccgcatgtttatgtgaacggaacgacggatatgtacccccaaaactcgctccaattttggtccttgtggatatgtacctgattcggccgtatgaacccttttggattgtgtaatagtacgtactcttatgaaacggagtactagtttggcgcattaacttggctgttcttccgtcggtttgctctctctttcttgc

SEQ ID NO: 3091 - DNA, 1409 bp, Zea mays
gaagtaagcgtggatgttgcccacgtggcccccggctcctccagaagtagccatacggattcagatcgcggccgcggcgactccccgagcagaagaacccgatcgaacgcggccgcggcggcgactccccgatctcagatccctgctgcgagcgaagtgttcgattcgagcagagatggcggcggcatgggcggtgctggctttgttcctcgtcgcggcgcaggtggcggcggcggcgccggtcacggcgccagcgttcctgtgggcgcccaaaaactacggattcagctctgatgatgctaaggaggtagtccattaccaaacaatctcaccaaagagcttagctaaatctgttctcgaggaaggtggctggtcaaacttcatgtgctcaagggaggatactcagaataatgttgatgttgccattgtttttattggctcaaagctgcaatcgtcagacatatctaaagataagcaagttgatccagctttagcagacacactgaagctctccttcacacgctcagagttttccatggcattcccctacgtttccaccacagtcgacgagagactagaggactcgttgctatccagctttgccgagaactgcaacaatggtttcggaagaaaccgcgtcacctacacagacacgtgtaccggtcaagatctgaagaaataccacaacatggatgccatcaatgacctggtagtgtcaggggtagcgtcaaggagagtcaaccacccaagtggacagaccgatgtaatcgtcttctgtagcggcgggttcgagaatccaggcactgcgaaatcagaaggagagctgctttcccagcttgtggacttgctggacttgtcgggagccaaatatacggtcctctatgcgtcccaaccgtctggtttgctggagagcccttcgggcctgccgctgggtaggcatctcgcggagaagaagactaacggcacgaaagctgtccagggcgaaaaatgcgatggcgagtgcctcgtcaaatctagtctcctcgaaggaactttcgttgggatagtgcttctcatcatcctgatatcaggactcatgtgcatgatggggatcgatactccctcgaggtttgaagctccccaggagtcttgatctctcccttggactgcagaatccgcgggggggttgtgacgagggcacgcggcggcgttgaggggggccggtgttctgttggtctgcactgtggatatatatcgtttagcttcccatttggaagggagtacgccttgtgtatttttttttaccgagccaactgtcactcacaatgtgctagaattttttggtgtaatatttggctatttgcgtttcgcgtctacggacaactaataagctgaggcctgaggcattgcagacaaaaaaaaaaaaaaaa

SEQ ID NO: 3092 - DNA, 1383 bp, Zea mays
cgcggccgcggcggcgactccccgatctcagatccctgctgcgagcgaagggttccattcgagcagagatggcggcggcatgggaggtgctggctgtgttgctcgtcgcggcgcaggtggcgtcagcggcgcaggtcacggcgccagcgttcctgtgggcgcccaaaaagtacggattcagctctgatgatgctaaggaggtagtccattaccaaacaatctcaccaaagagcttagctaaatctgttctcgaggaaggtggctggtcaaacttcatgtgctcaagggaggatactcagaataatgttgatgttgccattgtttttattggctcaaagctgcaatcgtcagacatatctaaagataagcaagttgatccagctttagcagacacactgaagctctccttcacacgctcagagttttccatggcattcccctacgtttccacgacagtcgacgagagactagaggactcgttgctatccagctttgccgagaactgcaacaatggtttcggaagaaaccgcatcacctacacagacacgtgtaccggtcaagatctgaagaaataccacaacatggatgccatcaatgacctggtagtgtcaggggtagcgtcaaggagagccaaccacccaagtggacagaccgatgtaatcgtcttctgtagcggcgggttcgagaatccaggcactgcgaaatcagaaggagagctgctttcccagcttgtggactcgctggacttgtcgggagccaaatacacggtcctctatgcgtcccaaccgtctggtttgctggagagcccttccggcctgccgctgggtaggcatctcgcggagaagaagactaacggcacgaaagctgtccagggcgaaaaatgcgatggcgagtgcctcgtcaagtcgagtctcctcgaaggaactttcgttgggatagtgcttctcatcatcctgatatcaggactcatgtgcatgatgggcatcgatactccctcgaggtttgaagctccccaggagtcttgatctctcccttggactgcagaatccgcgggggggttgtgacgagggcacgcggcggcgttgaggggggccggtgttctgttggtgtgcactgtggatatatattgtttagcttcccatttggaagggagtacgccttgtgtattttttttaccgagccaactgtcactcacgatgtgctagaattttttggtgtaatatttgcgtttcgcgcctatggacaactaataagctgaggcattgcagcagataaattcatgtgctgcgtgaggcaggcttgtgttgtgtaccagacgcacagcattgttgcctccagctagtgctttctgtgtgaaataaacctgaaacccagtcccaggcc

SEQ ID NO: 3093 - DNA, 1451 bp, Zea mays
aagacatcagcctctgttatcctggcccacacatcagcctccctggagtaagcgtggtagttgccactgccgtcccctccagaagtgcgatacagttcggattcagatcgcggccggtgcgaacccacgaaggcacgaacggtagaacccgaccgagcgcggcagcgcaaacctccgatccctgctgcgagcaagggatggcggcggcatgggcagtgctggcggcggtcctcgtcgcggcgcaggtggcgtctgcggcgccggtcacggcgccagcgttcctctgggcgcctaagaactacggattccgctctgatgatgctaaggaggtagtccattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcaagttgatccagctttagcagatacattgaagctctccttcacagaatcagagttttctatggcattcccctacgtttccacatcagacgatgagaaactggaggagtcattgctatcaggcttcactgagaactgtaaaagtggttttggaagaaaccgtatcacctacacagacacgtgcgccgtgagtggccaagatctgaagacgtatcacaacatggatgctatcaatgacttggtagtgtcaggaagaaccaacccgagtggacagactgatgtaatcgtcttctgcagcggcgggttcgagaagttaggcaccacggaatcggaaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgatctcccttcgaagcagaacccttgttttgttggtctgcactgtggatagatattattcagtttccccctttgaaagcgcctttcgtataattattattatttttttactgagccatctgttatttacgatgtgctcaaacttttgacaccaaacgaatgcatgtgtgtgaggcttgtgctgtgaccagacatagcattgcctccaggtgttttctgtgaataacctggaatttcaggtgggtactgtgcatcaaataaaaaagatgaaatcttgctgttgcaaaaaaaacaaaaaaaaaaaaaaaa

SEQ ID NO: 3094 - DNA, 1434 bp, Sorghum bicolor
agaagtagccatacggattcagatcgcggccgcggcgaccccccgagcagaggaacccgatcgagcgcggcagcgcaaatccccaatctcagatcctgctgcgccaaagccgggttcgattcgagcagatggcggcggcatgggcggtgctggcggtgttgctcgtcgcggcacaggtggcgtcggcggccccggtcacggcgccagcgttcctctgggcgcccaagaactacggattccgctctgatgatgctaaggaggtagtccattatcagacaatctcaccaaagagcttagctaaatctgttctcgaggaaggtggttggtcaaactttatgtgttcaagggaggatactcagaagagtattgatgttgctgttgtttttattggctcaaagctacaatcgtcagacatatctaaagataagcaagatgatctgactttagcagacacattgaagctctccttcacagattcagagttttccatggcattcccctatgtttccacatcagatgatgagaaattggagaactcattgctatctagctttgctgagaattgtaacagtggttttggaagaaaccgtatcacctacacagacacgtgtactgtaagtggtcaagatgtgaagaaatatacaaacatggatgctattgatgacttggtacggtatggcgtagggtcaaggagaattaacccaagtgaacagactgatataattgttttctgtagcggtgggttcgagaattttttcactccgaaatcagaaggagagttgctttcccagcttgttctcttgctggagcagtctggggctaaatacacgattctttatgcttcccaaccatctggtttactggagaacccttccagcttgccactaggtaggtatcttgcagagaagactaagggtacaaaaactggcgagggcaaatgtgatggagagtgcctagtcaaatcaactcttcttgagggaacttttgttggaatagtgcttcttatcatcctgatatcaggactcatgtgtatgatgggaatcgatactccctcgaggtttgaagctccccaggaatcttgatctccctttgaagcagaatctggggatttgacgaggcacagagtggagggactgatgtttgtcggtctacactgtggatattgtttagtttcccctttgaaagtgccttgtgtattttactgagccaactgttatttacaatgcgctcaaattttttgtgtaatattacgtttcatgtctatggacatctagctgagccattgcaaacaagcatatgtgactgtcaggcttgtgctgtactagacatagcattgcctgcagtgttttctgtgaataacctgaaattcaggtaaccaataagatgggtactatgcatcaaataaaatgaaatctttgccatttgtttgatcag

SEQ ID NO: 3095 - DNA, 1352 bp, Oryza sativa Japonica Group
aacgacgaacaacaacatctcgccacgaagaggagggcgagagcctgcacgagtccgaaatccccaatccgggttccctgcttctcttcgcgccaagatggcggctgcctgggcggcggtggtggccgtgatgctcctccttgcgcaggtgtcagccgcggctccggtgatggggcctgccttcctctgggcgcccaagaactacggattctcttctgatgaggctaaagaaatagtccattatcagacagtatccccgaagagcttagtgaaatctgttcttgaagaaggtggttggtcaaacttggtgtgttcaagggaggatcatgcaaagagtgttgatgttgcagttctttttcttggctcgaagctacaatcgtcagacatttctaaagataagcaagctgattctactttagtagacacgctgaagaactcgtttgcaagctccgagttttcgatggcattcccctacattgccatgtcagatgatgacaaattggagaagtcattgctatctgggtttgctgagaattgcaacaatggtttcggagataatcatatcacctacacagacacctgttctgtaagtgaagatctgaacaaacatcacaacatggattccattcatggattggtggcatcacaaactaaaaagaacccgagtggacagactgatctgattgtcttctgtgatggtggtttcaaggataacacaaaatcagaaggggagttgctttctgagctggttactctgctgaagaagtctggagctaaatatacgattctttatgcttctcagccctttggtttgctagagaacccttcaaacctaccattaggcaggtacctcgcagagaagaccaatactactaaacctggccgtggaaaatgtgacggggagtgcttagtaaaatcaactctgctggaaggaagctttgttggaatagtgctgctgatcatcttgatatcaggactcaaatgtatgatgggaattgataccccatcaaagttcgacgctcccccggaatcataagcccattttaaagcagttctgaatggaaactcagggcaagtgctagggaaaaattgaatagctgatgtagcaggaaatgtattgtgcatatagtaagttcgctacttgatgccttatgtattttaatgagccagctgcaatttgcagtcaatttttggtggaatattacatttcaatacgtacaagtgcaagccttgggttgtaccatataacactgcctccagtgtttgctgtgtgaataagctggaattcaggactccgagtagccaataagatgttatacaattcatctaataaaaccttgtgattctttcat

SEQ ID NO: 3096 - DNA, 2852 bp, Sorghum bicolor
atggcggcggcatcggcggcggtgcggatgctccccgacggcggcgctgacgacgaggagcggtggctcgccgagggcatcgccggcgtccagcaaaacgccttctacatgcaccgcgccctcgattccaacaacctcaaggacgcactcaagtactcggcgcagatgctctccgaactgcgcacctcgcgactatcgccgcacaagtactacgagctttacatgagggcgtttgatgagatgaagaagctggagatgttcttcagggaggagactcgccggggcagctgctctgtggttgatctgtatgagcttgtgcagcatgctgggaatgtcttaccgagactctatctcctctgcacagtgggatctgtgtacatcaaatcgaaagaggctcctgctaaagatgttcttaaagatcttgttgaaatgtgccgaggcattcaacatcctctccgtggccttttcctgagaagttacctttctcaaataagcagagacaaattgcctgatattggttctgagtatgaaggggatgcggaaagtattaacgacgcagttgaatttgttcttcagaatttcatagaaatgaacaaactctgggtcaggatgcagcatcaggggcctgtccgagaaaaggaaaagcgcgggaaggaaaggaatgaactgcgtgatctggtaggcaaaaaccttcatgttctaagccagattgagggcgttgaccttgatatgtacaaagaaactgttcttccaaggatattagagcaggtggttaattgtaaagatgaccttgcacagttctacctgatggactgcataatccaagtctttccagacgaataccatttacaaacactggaaacattattgagtgcatttccccagcttcagccaagtgttgatatcaaaacagtactctctcaacttatggacagattgtctaactatgctgcctcaagtcctgaagtgttgccagagttcttgcaagttgaagcttttgctaagttcagtagtgctattggaaaggtgatagaagcccaacctgacatgccagttgttggagccgtaactctctatgtgtcacttctgacttttactctccgtgtacatcctgatcggcttgattatgttgaccaagtgctgggtgcatgtgtcaagaaactttcaggcaaagcaaaacttgaagatagcagggcaacaaagcaaatcgttgcacttcttagtgctcccctggaaaaatatagcaatattgttactgcattagaactttcaaactatcctcgggttatggattatcttgataatgctacaaccaaagtgatggctgtggtaataattcaaagcataatgaaaaacacgacctgcatatctacttctgacaagattgagtcactattcgatttaattaaggggctgataaaggatatggatggggctcaagatgatgagcttgatgaagaagacttcaaggaggaacagaactctgtagcgcgtctaattcacatgttgcacaatgatgatcctgaagagatgctgaagatcttatgtactgtacagaagcatatacttcagggaggccccaagcgtttaactttcactgtgccttcgttagtattctctgctcttaagctggtcaggcgattacaaggtcaagatggagatgtcactggggaggatgttcctgcaactccaaagaaaatattccagatattgcatcagactattgaagcactttcttgtgttccttccccagagttagctctgagactatatttgcagtgtgcagaggctgccaatgactgtgatttggaaccagttgcttatgagttctttactcaagcgttcatcttatatgaagaagaaattgcggattcaaaggctcagatcactgcaattcacctgataattgggacccttcagcggatgaatatatttggggtggaaaatagagacaccctcactcacaagacaacagggtactcagcaaaacttctcaagaagcctgatcaatgccgagcagtctatgcgtgttcacatcttttctggactgatgaccaagatgggataatggatggtgaaagggttctcctttgtttgaagcgtgccttgagaatcgcaaatgctgctcaacagatggctagcgctacaaggggaagcagtggatccgtaaccctatttattgaaattttgaacaagtacttgtacttctttgagaaaggcattccacagatcacaaatactgtgattcaagatttgattgaattgattagaacagagaagcaaagtgataactctgtagctgatccatctacagaggcattcttttctagcactttgcggtacattgaatttcagaagcagaaaggtggaagcataggcgaaaaatatgaacaaataaagacaagttcatgagtcagaacaggcatggcataatgactggtttcgattttgttaagagaattgggtcgtttgtttggcatggttcagtgaaatagaaaccatcagttttagctgcctccaactaaaagatgtttatatgagctgttattctcaaatctcacggtctgagcgggtctgctcgcccatcggcaatactttcagatttagtcaggtggcaataagctgtcctttggggagcacaggtctgtacaggattacttgtgttcgtgatcagttctactgctacctgagtttcattgttgtatatttccgccccttatgcaaagcttatggattttagatttctgtaacatttggagtacatggcctccatttctgagttctgactggacattgatgattgtttcatagtggtcagtgaaggacttgaacattatggctgccgttcgttg

SEQ ID NO: 3097 - DNA, 2933 bp, Zea mays
caaacacccgcatcaatccaagccgagcctcccctcggggacagcctacgcgagcgagatccaacccaagtcccgacgccgcgggcgagggcgaccagatccacctcctcagtcgtctcggatggcggcagcatcgacgtcggtacgggtgctccccgacggcggtgctgacgacgaggagcgctggctcgccgagggcatcgccggcgtccagcaaaacgctttctacatgcaccgtgccctcgattccaacaacctcaaggacgcactcaagtactcggcgcagatgctatcagagctgcgcacctcgcgactatcgccgcacaagtactacgagctttacatgagggcgtttgatgagatgaagaagctggagatgttcttcagggaggagactcgccgaggcagctgctctgtggttgatctgtacgagcttgtgcagcatgctgggaatgtcttaccgagactctatctcctgtgcacggtggggtctgtgtacatcaaatcgaaagaggctcctgctaaagatgttcttaaagatctcgttgaaatgtgccgaggcattcaacatcctcttcgtggcctttttttgagaagttacctttctcaaataagcagagacaaattgcctgatattggttctgagtacgaaggcgatgtggaaaatattaacgatgcggttgaatttgttcttcagaatttcatagaaatgaacaaactctgggtccggatgcagcatcaggggcctgcccgagaaaaggaaaagcgtgggaaggaaagaaatgaactgcgtgatctggtaggcaaaaaccttcatgttctaggccagattgacggcgttgaccttgatatgtacaaagaaactgttcttccaaggatattagagcaggtggttaattgtaaggatgaccttgcacaattctacctgatggactgcataatccaagtctttccagacgaataccatttacaaacattggaaacgttattgagcgcatttccccagcttcagccaagtgttgatataaaaacagtactctctcaacttatggacagattgtctaactatgctgcctcaagtcctgaactgttgccagagttcttgcaagttgaagcttttgctaagttcagtaatgctattggaaaggtgatagaagcccaacctgacatgccagttgttggagccataactctatatgtatcacttctgacctttactctccgtgtacatcctgatcggcttgattatgttgaccaagtgctgggtgcatgtgtcaagaaactttcaggcaaggcaaaacttgaagatagcagggcaacaaagcaaattgttgcacttcttagtgctcccctggaaaaatatagcaatattgttactgcattagaactttcaaactatcctcgggttatggattatcttgataatgctacaaccaaagtgatggctgtggtaataattcaaagcataatgaaaaacacaacctgcatatctacttctgacaagattgaggcactattcgatttaattaaggggctgataaaggatatggatggagctcaagatgatgagcttgatgaagaagactttaaggaggaacaaaactctgtagcgcgtctcattcacatgctgcacaatgatgatcctgaagagatgctgaagatcttatgtactgtacagaagcatatacttcagggaggccccaagcgtctaactttcactgtgccttcgttagtattctcttctcttaagctggtcaggcgattacaaggccaagatggagatgtcactggggaggatgttcctgcaactccaaagaaaatattccagatattgcatcagactattgaagcactttcttgtgttccttctccagagttagctctgagactatatttgcagtgtgcagaggctgccaatgactgtgatttggaaccagttgcttatgagttctttactcaagcgttcattttatatgaagaagaaatcacggattcaaaggctcagatcactgcaattcacctgataattgggacccttcagcggatgaatatatttggggtggaaaatagagacaccctcactcacaagacaacagggtactcagcaaaacttctcaagaagcctgatcaatgccgagcagtatatgcgtgttcacatcttttttggactgatgaccaagatggtataatggatggtgaaagggttctcctttgtttgaagcgtgccttgagaatcgcaaatgctgctcaacagatggctagtgctacaagggggagcagtggatctgtaaccctatttattgaaattttgaacaagtacttgtacttctttgagaaaggaattccacaaatcacaaacactgtgattcaagatttgattgaattgattagaacggagaagcaaagtgataactctgtagctgatccatctacagaggcattcttttctagcactttgcggtacattgaatttcagaagcagaaaggtggaaccataggcgaaaaatatgaacaaataaagacaagttcatgactcggaacaaacacgtcacgatgactggttttgattttgttaagagaattggatcatttgtttgacatggttcagtgaaatagaaaccgccagttttagtagcatccaactaaaggatgtttacatgagctgttattctcaaatctcacggtctgagcgggtttgctcgcccattggcaacattttcaggtttagtcaggtggcaataagctgtcctttggtgagcacaggtctgtacaggattacttgtgttcgtgattggttctactgctacctgagtttcattgttgtatatttccgcccctcatacaaagcttatggattttagatttctgtaacatttggagtgcatgcctccatttctgagttctggctggacatttgatgattgtttcatagc

SEQ ID NO: 3098 - DNA, 2830 bp, Zea mays
gatcagatccacctcagccgtctcggatggcgtcagcatcgacggcggtgcggatgctccccgacggcggcgctgacgacgaggagcggtggctcgccgagggcatcgccggcgtccagcaaaacgccttctacatgcaccgcgccctcgattccaacaacctcaaggacgcactcaagtactcggcgcagatgctctccgaactgcgcacctcgcgactatcgccgcacaagtactacgagctgtacatgagggcgtttgatgagatgaagaagctggagatgttcttcagggaggagactcgccggggcagctgctctgtggttgatatgtacgagcttgtgcagcatgctgggaatgtcttaccgagactctatctcctgtgcacggtgggatctgtgtacatcaaatcgaaagaggctcctgctaaagatgttcttaaagatctcgttgaaatgtgccgaggcattcagcatccccttcgtggcctttttctgagaagttatctttctcaaataagcagagacaagttgcctgatattggttccgagtatgaaggggatgctgaaactattaacgacgcagttgaatttgttcttcagaatttcatagaaatgaacaaactctgggttcggatgcaacatctggggcctgcccgagaaaaggaaaagcgtgggaaggaaagaaatgaactgcgtgatctggtaggcaaaaaccttcatgttctaagccagattgagggtgttgaccttgatatgtacaaagaaactgttcttccaaggatattagagcaggtggttaattgtaaggatgaccttgcacagttctacctgatggactgcataatccaagtctttccagatgaataccatttacaaacattggaaacattattgaatgcatttccccagcttcagccaagtgttgatatcaaaacagtactctctcaacttatggacagattgtctaactatgctgcctcaagtcctgaagtgttaccagagttcttgcaagttgaagcttttgctaagttcagtaatgctattggaaaggtgatagaagcccaacctgacatgccagttgttggagccgtaactctatatgtatcgcttctgacttttactctccgtgtacatcctgaccggcttgattatgttgaccaagtgctcggtgcatgtgtcaagaaactttcaggcaaagcaaaacttgaagatagcagggcaacgaagcaaattgttgcacttcttagtgctcccctagaaaaatatagcaatattgttactgcattagaactttcaaactatcctcgggtcatggattatcttgataatgctacaaccaaagtgatggctgtggtaataattcaaagcataatgaaaaacacaacctgcatatctacttctgacaagattgaggcactattcgatttaattaaggggctgataaaggatatggatggggctcaagatgatgaacttgatgaagaagattttaaggaggaacagaactctgtagcacgtctcattcacatgttgcacaatgatgagcctgaagagatgttgaagatcttatgtactgtacagaagcatatacttcagggaggccccaaacgtttaactttcactgtgccttctttagtattctccgctcttaagctggtcaggagattacaaagccaagatggagatgtcactggggaggatgttcctgcaactccaaagaaaatattccagatattgcatcagactatcgacgcactttcttgtgttccttccccagagttagctctgagactatatttgcattgtgcagaggctgccaatgactgtgatttggaaccagttgcttatgagttctttactcaagcgttcatattatatgaagaagaaattgcggattcaaaggctcaaatcactgcaattcacctgataattgggacccttcagcggatgaatatatttggggtggaaaatagagacactctcactcacaagacaacagggtactcagcaaaacttctcaagaagcctgatcaatgccgagcagtttatgcgtgttcacatcttttctgggctgatgaccaagatgggataatggatggtgaaagggttctgctttgtttgaaacgtgccttgagaatcgcaaatgctgctcaacagatggctagtgctacaaggggaagcagtggatccgtaactctatttattgagattttgaacaagtacttgtacttctttgagaaaggaattccgcagatcacaaataccgtgattcaagatttgattgaattgattagaacggagaagcaaagtgataactctgtagctgatccatctacagaggcattcttttctagcactttgcggtacattgaatttcagaagcagaaaggtgggagcataggcgaaaaatatgaacagataaagacgagttcatgagtcagaactagcgcggcgccacgactggtttcgattttgttgagaattgggtcgtttgtttggcatggttcagtgaaatagaaaccataagttttagctcgctccatgtaaaagatgtttatacgagctgttaattctcaaatctcacggtctgagcgggtctgttcgcccattggcaacactttcaggtttagtcaggtggcaataagctgtgtcctttggggagcacaggtctgtacaggattacttgtgttcgtgatcagttctactgctacctgaatttcatcgttgtatatttccgccccttatgcgaagcttatggattttagatctctgtaacattcggagtacatgccttcatttctgagttctgactaaaaaaaaaaaaaaaa

SEQ ID NO: 3099 - DNA, 3010 bp, Oryza sativa Japonica Group
acttcggaaaacagaaaaaaaagaggaaaaaaccgatcataaaaaaacactcgaagaacacaaacactcgccccgatccaaacccgagaggggacaagcccacgcgcgagaggcgagatccaaccccaaccccaacccgagccaccagaggccgaccagatccacccccgcagccagcgaagacggcggccacggcggcggtcaggatgctgccggatggcggcgccgacgacgaggagcggtggctcgccgagggcatcgccggcgtccagcagaacgccttctacatgcaccgcgccctcgattcgaacaacctcaaggatgcgctcaagtactcggcgcagatgctctccgagctgcggacctcgcggctctcgccgcacaagtattatgatctatatatgagggcgtttgatgagatgcggaagctggagatgttcttcagggaggagacccgtcgtggcagctgctccgttgttgatttgtatgagcttgtgcagcatgctggcaacgtactgcccagactctatctcctctgcacagtaggatctgtgtacattaaatcaaaagaggctcctgcgaaagacgttcttaaagaccttgttgaaatgtgtcgaggcatccaacatcctcttcgtgggcttttcctaagaagctacctatctcagataagccgagacaaactgccagatattggttccgagtatgaaggggatgctgacagcattaacgtcgcagttgagtttgttcttcagaatttcatagaaatgaacaaactctgggtccgaatgcaacatcagggccctgttcgagagaaggagaagcggggaaaagaaagaaatgaactgcgtgatttggtaggcaaaaaccttcacgttctaagccagattgagggtgttgaccttgacatgtacaaagaaactgtccttccaaggatattagaacaggtggttaattgtaaggatgaacttgcacaattctacctgatggactgcataatacaagtctttccagacgaataccatttacagacattggaaacattgttgagcgcatttccgcaactacagccaaatgttgatatcaaaaccgtgctgtctcaactcatggacaggttatcaagctatgctgccgcaagtcctgaagtattgccagaattcttgcaagttgaagcttttgcaaagttcagcaatgctattggaaaggtgatagaggcccaagttgacatgccagttgttggtgcagtaactttatatgtatcacttttgacatttactctccgtgtgcatccggatcggcttgattatgttgatcaagtgttgggtgcatgcgtaaagaaactttcagggaatgcaaaacttgaagatagcagggcaacaaagcaaattgttgcacttctcagtgcccccctggagaaatatagcaatattgttactgcattagagctctcaaactatcctcgggttatggattaccttgataattctacaacaaaagttatggctcttgtaataattcaaagcataatgaagaacacgacttgcatatctacttctgacaagattgaagctctttttgatttaattaaaggtcttataaaagatatggatggggctcaaaatgatgagcttgatgatgaggattttaaggaggaacagaattctgtggcgcgtcttattcacatgttgcacaatgatgaccatgaagagatgttgaagatattatgcaccgttcagaagcatatacttcagggaggtcccaagcggctacctttcactgtgccatccttagtattctctgctctcaagttggtccgaagattacaaggtcaagatggtgatgtaataggggaggaagttcctgcaacgcctaagaaaatatttcagatcttgcatcagaccattgaagctctctcatgtgttccttctcctgaactggctctcagattatatctgcagtgtgcagaggcggccaatgattgtgatctggaaccggttgcttatgagttctttactcaagcattcatcttatatgaagaagaaattgcggattcaaaggctcaaatcactgcaattcatcttataattggaacccttcaacggatgaatatattcggggttgaaaatagagataccctgactcacaagacaacagggtactcagcaaaacttctaaagaaacctgaccaatgccgagcggtttatgcatgttcacaccttttctggactgacgaccaagacggaataatggatggtgaaagggtcctcctttgtttaaagcgtgccttaagaattgcaaatgccgctcaacagatggctaatgtaacaaggggaagtagcggatctgtcgcgctatttatcgaaattttgaacaagtatttgtacttcttcgagaaaggaattccagagatcacgaacactgtaatccaggatttgattgaattgattaggacagagaagcaaagtgagaacactgtagctgatccatcgacagaggccttctttgcaagcactttacgttacattgaattccagaagcagaaaggtgggagcataggtgaaaaatatgagcaaataaaaactacctgattgtgcactaagtcaaaacaagaacagcgtcacgacgtgttgtttttgtctcgagtcatatttgcggaagttcagtgaaatacaagccattggtctcagctgcctctggcctaaaggatctttgcatctgttgttatttgtgcatcttacgctcaaagcggggcctcccctccattttgtgacatgtttgggttagtcaggtggcaataagctttacccttgggaagctcagatctgtacagcgcaacttgtgtaccagagtatcattgttgtatatcctttttctttcttttctttttttgtcaaagaacaattttagggttctaacttttttaactttggaggtacatatttctatttatctggctggaccttttgcttaattcatagcaatgaaggcgttgaatttgaactatgttccg

SEQ ID NO: 3100 - DNA, 2914 bp, Hordeum vulgare subsp. vulgare
gacgagatccccaaccccccgagccagagccgccggccagatccgccgcgcacccggaggcggacaacacggcggccgccaggatgctgcccgacggcggcggcgacgacgaggagcgctggctcgccgagggcatcgccggcgtccagcagaacgccttctacatgcaccgcgccctcgactcgaacaacctcaaggacgcgctcaagtactcggcgcagatgctctcggagctgcgcacctccaggctctccccgcacaagtactacgagctatacatgagggcgttcgacgagatgcggaagctggagatgttcttcagggaggagacccgccggggcagctgctccgtggttgacctctacgagcttgttcagcatgctggcaacgtgttgccgagactttatctgctctgcacagtaggatctgtgtacattaaatcgaaagaggctcccgctaaagatgttctgaaagaccttgttgaaatgtgtcgaggcattcaacatcctctgcgtggacttttcctaagaagttacctctctcagataagccgagacaagctacctgatattggttcagagtatgaaggggatgctgatagcattaatgatgcagttgaatttgttcttcagaattttatagaaatgaacaaactctgggtccggatgcagcatcaggggcctgttcgggagaaggacaagcgggggaaggaaagaaatgaactgcgtgatctggtaggcaaaaaccttcacgttcttagccaaatcgaaggtgttgaccttgaaatgtacaaagagaatgttcttccaaggatatcagaacaggtagttaattgtaaggacgatcttgcacagttctacctgatggactgcataatccaagtcttcccagacgaataccatctacagacattggaaacattgttgagcgcctttccccagctacagccaagtgttgatatcaaaacggtgctttctcaactcatggacagattgtcaaactatgcagccacaagtcctgaagtactgccagagtttttgcaagtcgaagcttttgcgaagttcagcaatgctattggaaaggtgatagaagctcaagttgacatgccggttgttggagcagtaactttatatgtatcgctcctcacatttactctccgtgtgcatccagatcggcttgattatgttgaccaagtgctgggtgcatgcgtgaagaaactttctggcaaggaaaaacttgaagatagcagagcaacaaagcaaattgttgcacttcttagtgctcccctggagaaatatagtaatattgttactgcattggagctttcaaattatccccgggttatggattacctggataatgctacaacaaaagtgatggctctggtaataattcaaagcataatgaagaacacaacctgcatttctacttccgacaagatcgaggctctttttgatttaattaagggccttataaaagatatggatggggctcaagatgacgagcttgatgaagaggattttaaagaggagcagaattctgtagcacgccttattcacatgttgcacaatgatgatcacgacgagatgttgaagatcttatgtactgttcagaagcatatacttcagggaggtcccaagcgtctacctttcactgtgccgtccttagtattctccgctctcaagttggtcagacgattacaaggtcaagatggagatgtcactggggaggaagttcccgcaactcctaagaagatatttcagatcttgcatcagactattgaagcactccaatgtattccttgtccagaattgtctctcagactatatctacaatgcgcagaggctgccaatgattgtgatttggaaccggttgcttatgagttctttactcaagcattcatcttatatgaagaagaaatagcggattctaaggcccaaattactgcacttcacctaataattggaacccttcagcggatgaatatatttggggtggaaaatagagacaccctcactcataagacaacagggtactcagcaaaacttctaaagaagcctgatcaatgccgggcagtctatgcatgttcacaccttttctggactgatgaccaagatggaatcatggatggtgaaagggtcctcctttgcttaaagcgtgctttgcgaattgcaaatgctgctcaacaaatggctaatgtatcaaagggaagcagcggatctgtcattctatttattgaaattttgaacaagtatctgtacttctttgagaaaggaattccacaaatcacgaacactgtcatccaagatttgatcgaactgatcaggacagagaagcaaaatgacagcagtgcatctgatccatctgccgaagctttctttgcaagcactctacgatacatcgaattccagaagcagaaaggtggaagcataggagaaaagtatgaacagataaaagcttcgtaactcgagacaagtagggcattgcgacaaggagtttccattttggctggcagagagaaagcaagcccatttttttggtgacgtgttgagtaaaaacacaacctaatggtttcagctgcctccgaccagaaaatgtttgcaaagtttgtggtttctgaatctcatgctcaaatcggtgcatgtccaccctttagctacaatgtttgggttacttactacagtcgatcaggtggtaataagctgtactctttgggaagctcaggtctgtacaggatacttgtgtaccggagtgccattgttgtatattcctttttcttctagttattttgcaaagcgtgtgaattttaggtggacactcggagtacatatttatatttatcagactggtgttttgattaatttatagtgatgaagtcattgaatttagaaatatatatttatctgttgtgctt

SEQ ID NO: 3101 - DNA, 2678 bp, Vitis vinifera
atttgccttactgactttgggaatttgttactggagaaatcattccggggagaggcggtctccgctgtgaaggtcctctccaggcactggtagaagatgatatcgaacatagcagaggacgaggataaatggcttgccgaagggatcgctgggattcaacacaacgccttttatatgcatcgttctgtggactccaacaatctcagagaagtcctcaagtactccgctcagatgctgtcggagcttcggacttctagactctctcctcacaaatactacgaactctatatgcgagcttttgatgaattgaggaagctggagatattctttaaggacgaaagcaggcatggttgttctatcattgatctgtatgagctagttcagcatgccggaaacatattgcctagactgtatctcttatgtacggtaggatctgtatatatcaaatcaaaggaggctcctcctaaggatgtccttaaagatcttgtggaaatgtgccgtggtattcaacatcctatacgtggacttttcttaagaagttacctttctcaagtcagtagagataaattacctgacattggctctgactatgaaggagatgctgacactgtcatggatgctgtagaatttgtactacagaacttcacagagatgaataaactttgggttcgcatgcagcatcagggacctggccgggcaaaagagaaacaggaaaaggaaagaagtgaacttcgggatcttgttgggaagaatctacatgttctcagtcagattgagggtattgaccttgaaatgtataaagatactgttcttcccagggtcttagagcaggtggtcaactgtaaagatgagcttgcacaatattatttgatggattgcataattcaggtatttcctgatgagtaccacttgcagacacttgagacgttgttaggtgcttgcccccaacttcagcctactgttgacatcaagacagtgttgtctcaactaatggagagattatcaaactatgcagcttcaagtgcagaagtattacctgacttcctgcaagtagaagcttttgctaaattgagcagtgccattgggaaggtgatagaagcacaggttgacatgcctgtttttggagcaataactttatatgtctctcttcttacatttactcttcgtgttcatcctgatcggcttgattatgtggatcaagtactgggagcatgtgttaagaaactctctggcaagccaaagcttgaagatagtaaggcaacaaaacaaattgttgcacttttgagcgccccattggagaagtacaatgatattgtcacagccctgacactttctaattatccccgtgttatggaccatctcgataatggaacaaataaaatcatggcaatggttattattcaaagcattatgaaaaacagtacttgtatttctactgctgacaaggttgaagccttatttgaattaataaaaggactgattaaggatttggatggatttcctgtggacgagcttgatgaggaggatttcaaggatgaacaaaattctgtcgctcgtctcatacacatgttctacaatgatgaccccgaagaaatgttgaagattatatgcactgtgaagaagcatattatgactggagggttgaggcgcctaccttttactgttcctcctcttattttttctgctctcagattggtcaggcgattgcaaggtcaggaaggtgatgttgttggtgaagaagagcctgcaactcccaaaaaaatatttcaacttttaaatcagactattgaggctctttcatctgttccttcacctgaactggcattaaggttgtacctgcaatgtgctgaggctgctaatgactgtgatcttgagcctgttgcttatgaatttttcactcaggcattcatattgtatgaagaagaaattgcggattccaaagctcaagtgactgcaattcatctaataattgggactctgcagaggatgaatgtttttggtgttgagaatagggatacattaacgcacaaagccaccgggtattcagcaaagcttttaaagaaacctgatcaatgcagagcagtttatgcatgttcccatcttttttgggttgacgatcaagatggcattaaggatggagaaagggtcatgctttgcctaaagcgtgcattaaggattgccaatgctgctcaacaaatggccaccgttgcacggggtagcagtggaccggtcatactctttgtggagatactgaacaagtacatttatttttttgagaaggggaactcacaggtcacaagttcagcaatccagggtttgatagaattaattacaagtgagatgcaaagcgagtccactaccccagatccaccttcagatgctttctttgccagcacaatgcggtacattcagttccagaaacagaaaggtggtgcgatgggtgagaaatatgattctatcaaagcgtgaaagatggacccaagaagataagggccataaaagaaaattgttgtttgaattcgttttggggttggaaaaatggtggtatgggtgttgagaactgatctcctcgccctgaggaaatgagagctgtgttttcaaggtacacaaaatagttttcttcatgatatatctatgtaaacattcatgtatttattaaaagtagttggttgagtgtc

SEQ ID NO: 3102 - DNA, 2672 bp, Vitis vinifera
atttgccttactgactttgggaatttgttactggagaaatcattccggggagaggcggtctccgctgtgaaggtcctctccaggcactggtagaagatgatatcgaacatagcagaggacgaggataaatggcttgccgaagggatcgctgggattcaacacaacgccttttatatgcatcgttctgtggactccaacaatctcagagaagtcctcaagtactccgctcagatgctgtcggagcttcggacttctagactctctcctcacaaatactacgaactctatatgcgagcttttgatgaattgaggaagctggagatattctttaaggacgaaagcaggcatggttgttctatcattgatctgtatgagctagttcagcatgccggaaacatattgcctagactgtatctcttatgtacggtaggatctgtatatatcaaatcaaaggaggctcctcctaaggatgtccttaaagatcttgtggaaatgtgccgtggtattcaacatcctatacgtggacttttcttaagaagttacctttctcaagtcagtagagataaattacctgacattggctctgactatgaaggagatgctgacactgtcatggatgctgtagaatttgtactacagaacttcacagagatgaataaactttgggttcgcatgcagcatcagggacctggccgggcaaaagagaaacaggaaaaggaaagaagtgaacttcgggatcttgttgggaagaatctacatgttctcagtcagattgagggtattgaccttgaaatgtataaagatactgttcttcccagggtcttagagcaggtggtcaactgtaaagatgagcttgcacaatattatttgatggattgcataattcaggtatttcctgatgagtaccacttgcagacacttgagacgttgttaggtgcttgcccccaacttcagcctactgttgacatcaagacagtgttgtctcaactaatggagagattatcaaactatgcagcttcaagtgcagaagtattacctgacttcctgcaagtagaagcttttgctaaattgagcagtgccattgggaaggtgatagaagcacaggttgacatgcctgtttttggagcaataactttatatgtctctcttcttacatttactcttcgtgttcatcctgatcggcttgattatgtggatcaagtactgggagcatgtgttaagaaactctctggcaagccaaagcttgaagatagtaaggcaacaaaacaaattgttgcacttttgagcgccccattggagaagtacaatgatattgtcacagccctgacactttctaattatccccgtgttatggaccatctcgataatggaacaaataaaatcatggcaatggttattattcaaagcattatgaaaaacagtacttgtatttctactgctgacaaggttgaagccttatttgaattaataaaaggactgattaaggatttggatggatttcctgtggacgaggaggatttcaaggatgaacaaaattctgtcgctcgtctcatacacatgttctacaatgatgaccccgaagaaatgttgaaggtaattgatttgttcaagaagcatattatgactggagggttgaggcgcctaccttttactgttcctcctcttattttttctgctctcagattggtcaggcgattgcaaggtcaggaaggtgatgttgttggtgaagaagagcctgcaactcccaaaaaaatatttcaacttttaaatcagactattgaggctctttcatctgttccttcacctgaactggcattaaggttgtacctgcaatgtgctgaggctgctaatgactgtgatcttgagcctgttgcttatgaatttttcactcaggcattcatattgtatgaagaagaaattgcggattccaaagctcaagtgactgcaattcatctaataattgggactctgcagaggatgaatgtttttggtgttgagaatagggatacattaacgcacaaagccaccgggtattcagcaaagcttttaaagaaacctgatcaatgcagagcagtttatgcatgttcccatcttttttgggttgacgatcaagatggcattaaggatggagaaagggtcatgctttgcctaaagcgtgcattaaggattgccaatgctgctcaacaaatggccaccgttgcacggggtagcagtggaccggtcatactctttgtggagatactgaacaagtacatttatttttttgagaaggggaactcacaggtcacaagttcagcaatccagggtttgatagaattaattacaagtgagatgcaaagcgagtccactaccccagatccaccttcagatgctttctttgccagcacaatgcggtacattcagttccagaaacagaaaggtggtgcgatgggtgagaaatatgattctatcaaagcgtgaaagatggacccaagaagataagggccataaaagaaaattgttgtttgaattcgttttggggttggaaaaatggtggtatgggtgttgagaactgatctcctcgccctgaggaaatgagagctgtgttttcaaggtacacaaaatagttttcttcatgatatatctatgtaaacattcatgtatttattaaaagtagttggttgagtgtccaa

SEQ ID NO: 3103 - DNA, 822 bp, Sorghum bicolor
atggccaagaaattttcttatatatatgaaggcagacctaagacaaactcgggtttattcatgcagtccctctttctgcattgtattggtcatttgacttctcaaagttcactaccccaaagattggctggactttactgcctttactgtctgtatgagtgccagccatacaagccacagttcaagatttatttgtctcttgaggagtccaggcaactgaaagatttcgttgttatggctaagcaaaatggactgcagctcgtgcctgcacttgtcaaaaggatgctcgataaaggcatgtttttgcttggctacatgaatttgattgatgacaatggggacaagcaggttgaggagttgactgcattgcagaacaagcgagtaaaatttgcctgtgacaagttatttgcaaatacccaagcagaaagttatatgcacatggacttgggtgctgagtttgagcttgatagcatcaagaaattgtcaaaggagtacgcagaagcaaaggaattggcccttgcagaggcaagccagattgtggaagttgaagatgctaagcacctccttcagagtgacaagctgttgggtgacaagatagacgaagtcgtcaaagaatgggatgcccagaaggaggggttctacgagagaacaggattaacccctcgcaatcagctcatggtggttgacaatgatgaaccaggagtacaagctcatgaggacgcatcccatagcaatcagatcatggcgatttacaatgatgaatcaggagtacaaaatcacgaggaggacgactttgatgacttagatcagctgctagagtga

SEQ ID NO: 3104 - DNA, 1485 bp, Zea mays
cgagtcccgaccccgtcctgctcgctccgccgtccttcgcccgccacccgccacccgccggactgccaaagcccggaggcctgaggcccgagttacgcgaggagcagccgaaccagcggcccggcgcctcatccctcagcggccccgcccctggggccgtgtagtcagcaagcggccacgcgagtgcgcggtcggcgcggagtgagcaggagcaacccgtggctggcggtcagtcggtggctagctggagcctggagttgcgacttgcgagcggcgttagaactcgctccacctataatttttgtgtggctccgtcactgattccacccgttctgtggccggcgacagaggcacagagaagcgccaatccgccggcttgatctgaagcatggacagggagaactgtacgtcactctttgaattcaaacgagtatggatgggcaagaaattttcttatatctatgaaggcaggcctaagacaaactcgggtttattcatgcagtccctctttctgcattgtattggttatttgacttctcaaagttcactgcaccaaagattggctgggctatactgcctttactgtctgtatgagtgccagccatacaagccgcagttcaagatttacttgtctcttgaggagtgcaggcaactgaaagatatcgttgttatggcgaagcaaaatggactgcagctcgtgcctgcacttgtcaaaaggatgctggataaagacatgtttttgtttggctacatgaatttgatcgacgacaacggggacaagcaggtcgaggaattgaccgcattgcagaacaagcgagtaaaatttgcatgtgacaagttatttgcaaatacccaagcagaaagatatttgcacatggacttgggtgctgagttcgagcttgatagcatcaagaaattgtcaaaggagtatgcagaagcaaaggaactggcccttgcagaggcaagccaaactgtcgaagttgacgatgctaagcacctccttcagagtgagaggctgttgggcgacaagatagatgaagtcgtcaaagaatgggatgtccagaaggaggggttctacgagaggacaggattatcctcatcccctggcgaccagctcatggccatcgacaacgatgaatcaggagctcaatgtcacgaggatggatcccgtggcgatcagctcatggcggtcgacaatgatgaatcgggagtacaggatcacgaggacctcgacgacgacgacggctttgccgagttagaactgctgctagaatgaagaacatatacaagtctgtaaactcttactaccgccgtataaccgtgtaatcagaacaccgagagatgtaatcctcgctcgtctttactagcctctcctttttaggtgccagaccttctgttcatctacactggctgcagtaactgtacattgaaataatccagtgcgccagcctatgcaggggagaaaagaaagaggtgagcttgagt

SEQ ID NO: 3105 - DNA, 1889 bp, Zea mays
cgcccgccacccgccacccgccggactgccaaagcccggaggcctgaggcccgagttacgcgaggagcagccgaaccagcggcccggcgcctcatccctcagcggccccgcccctggggccgtgtagtcagcaagcggccacgcgagtgcgcggtcggcgcggagtgagcaggagcaacccgtggctggcggtcagtcggtggctagctggagcctggagttgcgacttgcgagcggcgttagaactcgctccacctataatttttgtgtggctccgtcactgattccacccgttctgtggccggcgacagaggcacagagaagcgccaatccgccggcttgatctgaagcatggacaggcgagtaattttgcaagtggaatatagatcgatctgaagctatgcatctgtgtgaattgtgccaagaggaaacatactcagttatttgggttcagcaagatggggtataaaccttatcaagttgcaaaccctcatcaccggtcgttgctggttctgccctctgttgctgaagatcgtgaccatggaactcgcgtcgtcgtcctagagctcctcgcgatgttgctgctccaggctgccatcctcatgtcaacggtggagggccttgtgcggatcgtgcaagaagctccacaagttcctcatcaataagatcagtttgaggcttggccatgcctttaaatatagatattgatctgttcaagctggatattgatgagctgatagctgattattccaaggagaactgtacgtcactctttgaattcaaacgagtatggatgggcaagaaattttcttatatctatgaaggcaggcctaagacaaactcgggtttattcatgcagtccctctttctgcattgtattggttatttgacttctcaaagttcactgcaccaaagattggctgggctatactgcctttactgtctgtatgagtgccagccatacaagccgcagttcaagatttacttgtctcttgaggagtgcaggcaactgaaagatatcgttgttatggcgaagcaaaatggactgcagctcgtgcctgcacttgtcaaaaggatgctggataaagacatgtttttgtttggctacatgaatttgatcgacgacaacggggacaagcaggtcgaggaattgaccgcattgcagaacaagcgagtaaaatttgcatgtgacaagttatttgcaaatacccaagcagaaagatatttgcacatggacttgggtgctgagttcgagcttgatagcatcaagaaattgtcaaaggagtatgcagaagcaaaggaactggcccttgcagaggcaagccaaactgtcgaagttgacgatgctaagcacctccttcagagtgagaggctgttgggcgacaagatagatgaagtcgtcaaagaatgggatgtccagaaggaggggttctacgagaggacaggattatcctcatcccctggcgaccagctcatggccatcgacaacgatgaatcaggagctcaatgtcacgaggatggatcccgtggcgatcagctcatggcggtcgacaatgatgaatcgggagtacaggatcacgaggacctcgacgacgacgacggctttgccgagttagaactgctgctagaatgaagaacatatacaagtctgtaaactcttactaccgccgtataaccgtgtaatcagaacaccgagagatgtaatcctcgctcgtctttactagcctctcctttttaggtgccagaccttctgttcatctacactggctgcagtaactgtacattgaaataatccagtgcgccagcctatgcaggggagaaaagaaagaggtgagcttgagtaaaaatgtacatgaacagtgacaagaaaaaaaaacgctggctgcagt

SEQ ID NO: 3106 - DNA, 1449 bp, Zea mays
attttacaatactacctccctctcgcttcctcctctcactgcagccctcatcaccggtcgttgttggttctgccctctgttgctggagatcgtgaccatggaactcgcgtcgtcgtcctagaactcctcgcgatgttgctgctacaggctgtcatcctcatgtcaacggtggagggccttgtgcggatcgtgcaagaagctccacaagttcctcatcaataagatcagtttgaggcttggccatgcctttaaatatagatattgatctgttcaagctggatattgatgagctgatagctgattattccaaggagaactgtacgtcactctttgaattcaaacgagtatggatgggcaagaaattttcttatatctatgaaggcagacctaagacaaactcgggtttattcatgcagtccctctttctgcattgtattggtcatttgacttctcaaagttcactgcaccaaagattggctgggctatactgcctttactgtctgtatgagtgccagccatacaagccgcagttcaagatttacttgtctcttgaggagtgcaggcaactgaaagatgtcgttgttatggcgaagcaaaatggactgcagctcgtgcctgcacttgtcaaaaggatgctggataaagacatgtttttgtttggctacatgaatttgatcgacgacaacggggacaagcaggtcgaggaaatgaccgcattgcagaacaagcgagtaaaatttgcatgtgacaagttatttgcaaatacccaagcagaaagatatttgcacatggacttgggtgctgagttcgagcttgatagcatcaagaaattgtcaaaggagtatgcagaagcaaaggaactggcccttgcagaggcaagccaaactgtcgaagttgacgatgctaagcacctccttcagagtgagaggctgttgggcgacaagatagatgaagtcgtcaaagaatgggatgtccagaaggaggggttctacgagaggacaggattatcctcatcccctggcgaccagctcatggccatcgacaacgatgaatcaggagctcaatgtcacgaggatggatcccgttgcgatcagctcatggcggtcgacaatgatgaattgggagtacaggatcacgaggacctcgacgacgacgacggctttgccgagttagaactgctgctagagtgaagaacatatacaagtctgtaaactcttactaccggcgtataaccgtgtaatcagaacaccgagagatgtactggcttgtttggtttgtggctaaatgtgccacactttgcctaaggttagtcgttcgaattgaataactaaccttaggcagaaaagttaggcaaagtgtggcaactgaggtagtgaaccaaacaggcctgtaatcctcgctcgtctttactagcctctcctttttaggtgccgaaaaaaaaaaaaaaaa

SEQ ID NO: 3107 - DNA, 1553 bp, Hordeum vulgare subsp. vulgare
ggacggcgcgaggaaggagcagcccttgccggcggctgaccgcagctcccccctccctctaaccctctccgccatccatccccggccctagcctcctctgtcgcccggccttctcctgcctggtcgcgtgcctgggcagcccggcgcccggcgcccgtcaatccattccgagggcggcgcctggctgggctccggcgccaaccggcccgcagccgcagctcgcctcgtcctgcgtccctgctctgcctcgccttcctgtcgtgctcgcctgccccgggactcccgcgtgcctccattgccacgggttgcaggagccccaacctgctcggccgcccctctactcggcagtgcccgggtcctctgcctacatcgaaggttcacgtttgccattgactttaagtatggatctcgcccctttcaagatggatattgacgagttactagatgattataccaaggaaaattgcacgtcattcactgatttcaagagagtgtggatggccaagaagttttcttatatctatgaaggcaggcccaagacgaactcgggcgtttttatgcaatccctctttttgcattgtattggccatatgacttcccaaagttctctacttcagaggttgcctgggctttactgcctttactgcctttatgagtgtcaaccatacaagccacacttcaaaatttatctgtctcttgaggagtccaagaaactcaaagactttgtcattgaggctaagcagaacgggcttggtcttgtaccagcacttgtcaaaaggatgctagataaaggcatgtttctgtttgggttcataaatttgcttggtgacattgtggcaaaggaggttgatgaaatgaatgcatcccagaataaacgggtggaatttgcctgtgacaagttgtttgcaaatactcaaatagggagttatacgcacacagatttgggagtggagtttgaacttgacagcatcaagaaattgtcaatggactacgctaaagccaaagaatcagcttttgcagaggcaagccaaactgttgatgtggaagatgccaagcacatccttcagaatgacaaactgctgggtgacaaagtagaggaaatcgtcaaagagtgggatgcccagaaggaagagttctaccagaaaacaggtgtatctcctcatgatgaaatggtggtggttgacaacgacgaatctggagaattctatgacgaaaatgaaaccgacgcctttgatgagttagaacagctgctgctggagtgagggaaagcatccagtagtctctgaatgactgaagaactgttcctctgctcatgtccctgctcatgtcattttgccacggcatggaatcgacattgggctgactgaacaggcccaaaatattcttgaaagcattttttgtcacagcatgcctgaagcaaaaaaaaaaatgtaggtagttctattttggtcggatgaaatgttgcctgatgtacatatctccgttgatcaaactggggtttcctaattttgggaatgtagcaattttgcatgcctctatcagtctatccgtat

SEQ ID NO: 3108 - DNA, 1476 bp, Sorghum bicolor
atgaagacccggagctcagcgagaggggagccgaggcggctcgggaatgcggctctcctggcgctcatgctctgctccgtcgtcgcgctctccctcatccgggggaggttcgccccaattggtagcaccgcaggagacgccatcaaatccgaggacgacgctgctgcagcggcggtggcggtcagcaaggcggctgctgtcaacgttgacaccggcgacggcgccgacgaggccgccgctgaagctgctgctgaggagaaagacaaggaggaggtccagccgaagccagccgccgacggttcccgcggcggcgcagccaagccggtgtgctacgagacgagccgccgctccgacacctgcgaggcggctggcgacgtgcgcgtgttggggagctcccagacggtgtacgtcgactcgctggaccgggagtggaagaccaagccgtactgccggaagcacgacaacttcgcgctcgcccacgtcaaggagtggtccctcaagccgctcccctccggcgctgcgccgcagtgcacggtgaacagctcggccaccgcgttcgtgctctccacgggcggcttcacgggcaacccgttccacgactacacggacgtgctgatcccggccttcatcacggcgcacccgctccgcggcgaggtccagttcctggtcagcagctacaagtcgtggtggatgaaccgctacatccagatcttccagcagatgagccggcacgaggtggtggacatcgacgccgacgacgaggtccgctgctaccggaacgtggtggtggggccgacgttccaccgtgagctcggcgtggacgcgtccaagtccccgtcgccggggtactccacggccgacttccgcaagatgctgcgcgacgcgttcgggctggagcgcgccacggccacgcccagcggcgaccggtgggacatccggcgccggccgcggctgctcatcatctcgcgccgcccgtcccgcgggcgcgccttcatgaacgagcgcgccatggcggacatggcggcgagcctcgggttcgacgtgcggatcggggagcccgacagcagcaccgacacgtccaagttcgcgcggctggtgaactcggcggacgtgatggtgggcgtccacggcgccgggctcaccaacatggtgttcctgccggccggcgccgtggtggtgcaggtggtgccgtacggccggctggagtggctggcccggaacacgttcgcggagccgtcggcggggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcgcccgcacctgggccgcctcaagaacaccttcctacaggcgctcaagatgctgccgcacggccgggacgattga

SEQ ID NO: 3109 - DNA, 1514 bp, Zea mays
ctcagaagagagggtgagatgaagactcggagctcagcgagaggggagccgaggcgtctcggaaatgcggctcttctggcgctcatgctctgctccgtcgtcgcgctctccctcatccgggggagattcgccccaattgtcactaccgcaggagatgccatcaaatccgaggacgacgctgcggcggctgcgctcagtgtcagcaaggcggccgtcaacgttgacaccggcgacagcgccgacgaggccgccgccgaagctgctgctgaggagaaagagaaggaggaagtccagccgaagcccgctgacagttccggctccggttccggtggcagcgcagccaagccggtgtgctacgagacgagccgccgctccgacacctgcgaggcagctggcgacgtgcgcgtcgtggggagcacccagacggtgtacgtggactcgctggaccgggagtggaagaccaagccgtactgccggaagcacgacaacttcgcgctcgcccacgtcaaggagtggtccctgaagccgctcccctccggcgcggcgccgcagtgcacggtcaacagctcggccaccgcgttcgtgctgtccacgggcgggttcaccggcaacccgttccacgactacacggacgtgctcatcccggccttcatcacggcgcacccgctccgcggcgaggtccagttcctggtgagcagctacaagtcgtggtggatgaaccgctacatccagatcttccagcagatgagccggcacgaggtggtggacatcgacgcggacgacgaggtccggtgctaccgcagcgtggtggtgggggcgacgttccaccgggagctgggcgtggacgcgtccaaatcgccgccggggtactccacggccgacttccgcaagatgctgcgcgacgcgttcgggctggagcgtgccacggccacgcccagcggcgaccggtgggacatccggcgccgcccccggctgctcatcatctcgcgccgcccgtcccgcgggcgcgccttcatgaacgagcgcgccatggcggacatggcggccagcctggggttcgacgtgcggatcggggagccagacaccagcaccgacacgtccaagttcgcgcggctggtgaactcgtgcgacgtgatggtgggcgtccacggcgccgggctcaccaacatggtgttcctgcctgccggcgccgtggtggtgcaggtggtgccgtacgggcggctggagtggctggcgcggaacacgttcgcggagccgtcggcggggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcggccgcacctgggccgcctcaagaacaccttcctccaggcgctcaagatgctgccgcacggccgggacgattgataagtcaaattagttga

SEQ ID NO: 3110 - DNA, 1580 bp, Saccharum officinarum
cggacgcgtgggttttgccctgcgctgtcactccacccgcgacgcagctgcttctactgaaagctctttcccagaataaaaggctctctgtctcagtgagaggaggaggaggaggcggcggcgggatgaagacccggagctcagcgagaggggagccgaggcggctcgggaatgcggctctcctggcgctcatgctctgctccgtcgtcgcgctctccctcatccgtgggaggttcgccccaattggagatgccatcaaatccgaggacgacgctgctgcggcggcggtggcggtcagcaaggtggctatcaacgttgacaccggtgacggcgccgacgaggccgccgtcgaagctgctgctgaggagaaacagaaagaggaggtccagccgaagccggccgacggttccggcggcggcgcagcaaagccagtgtgctacgagacgagccgccgctccgacacctgcgaggcggccggcgacgtgcgcgtcgtggggagctcccagacggtgtacgtcgacttgctggaccgggagtggaagaccaagccgtactgccggaagcacgacaacttcgcgctcgcccacgtcaaggagtggtccctcaagccgctcccctccggcgcggcgccgcagtgcacggtgaacagctcggccaccgcgttcgtgctgtccacgggcggcttcacgggcaacccgttccacgactacacggacgtgctcatcccggccttcatcacggcgcacccgctccgcggcgaggtccagttcctggtcagcagctacaagtcgtggtggatgaaccgctacatccagatcttccagcagatgagccggcacgaggtggtggacatcgacgccgacgacgaggtccgctgctaccgcagcgtggtggtggggccgacgttccaccgggagctcggcgtggacgcgtccaagtccccctcggggtactccacggccgacttccgcaagatgctgcgcgacgcgttcgggctggagcgcgccacggccacgcccagcggcgaccggtgggacatccggcgccgcccgcggctgctcatcatctcgcgccgcccgtcccgcgggcgcgccttcatgaacgagcgcgccatggcggacatggcggcgagcctcgggttcgacgtgcggatcggggagcccgacagcagcaccgacacgtccaagttcgcgcggctggtgaactcgtgcgacgtgatggtgggcgtccacggcgccgggctgaccaacatggtgttcctgccggccggcgccgtggtggtgcaggtggtgccgtacgggcggctggagtggctggcccggaacacgttcgcggagccgtcggcggggatggaggtccactacctggagtacgtggtgcagatggacgagacgacgctgagcgagcagtacccgagcgatcacccggtgctgagggaccccatggccatccacaagcaggggtaccgggcgctcaaccggacgtacctggacaagcagaacgtgcgcccgcacctgggccgcctcaagaacaccttcctacaggcgctcaagatgctgccgcacggccgggacgattga

SEQ ID NO: 3111 - DNA, 1990 bp, Hordeum vulgare subsp. vulgare
ggagcagctgcctttgctgcttttgctctgctcttccctccccttccttccctttctcccccctccaccgggctcgctgccggtggccgccgcttccgccgcccgctttatcccccgctgatttacacgtcagctgctcagctcgagtcgcatagcaaggctgtggaggtcctgtgcggagtaaagaactactcctactcccggaggagatgaagtcccggagctctgcgaggggcgagccgaggaggttcgggaatgtggctctcctggccctcatgctctgctccctcgtcgcgctctcgctcatcagggcaaggttctccccaatcgggaatacgcccgttgtggagaccatcaaagtggaggatccgaagccggtgttgccgagcaagccggctgtcgccgcgcaggccggcgatggcgccgacgaggccgccgcagttgctgtggaggaagacaaggaggaggaaattcagcccaagaccgagcaggccgtgggcgccacagtgcggccagccaaagccgccgtggtcgttgacgccagcaagccggtgtgctacgagacgagtcggcgctccgacacctgcgaggcagccggcgacgtgcgcctggtggggagaagccagaccatctacatcgatacgctggagcgggaatggaagaccaggccgtactgccggaagcacgatacctacgcgttgtcccacgtcaaggagtggtctctgaagccgttcccctccggcgacgacgcggcgcccaagtgcacgtccaacagctcggccaccgccttcgtgatctcgacgggcgggttcaccggcaaccccttccacgactacacggacgtgctcatcccggccttcatcacggcccaccgcttcgccggcgaggtccagttcctggtgagcagctacaagtcgtggtggatgagcaggtacatccagatcttccagcagatgagccggtacgaggtggtcgacatcgacgccgacgacgaggtccggtgctacccgagcgccgtggtcgggccgaccttccacaaggagctgggcgtggatccctccaaggcgccgtcgggcgcctcgatggcggacttccgcaagatgctccgcaacgcgttcgggctggagcgcgccactgcgacgccgagcggcgaccggtgggacatccgccgccggccccgactgctgatcatctcccggcgcacctcacgcgggcgggcgttcatgaacgagcgcgccatggccgacatggcggggagcctggggttcgacgtccgcatcggggacccggacacgacctccgacacgtccaagttcgcgcggctggtgaactcgtgcgacgtgatggtgggcgtgcacggcgccgggctgaccaacatggtgttcctcccggcgggcgccgtgctggtgcaggtggtgccgtacgggcggctggagtggctggcccgaaacacgttcgcggagccgtcggcgggcatggaggtgcactacctggagtacgtggtgcagctggacgagacgacgctgagcgagcagtaccccagcgaccacctggtgctcaaggaccccatggccatccacaagcagggctgggacgcgctcaagaccacctacctcgacaagcagaacgtccggccgcacctcggccgcctcaagaagaccttcctccaggcactcaagatgctgccgcacggccgggacgattagaccagctttagttcaccgtcgtccccatcatcgcgggagctttgagagctgctggtagcctagtatcatcagtaatagtgtacaaaatggatgcagaggacaagtgtctataaccttttctctgttttcgcctaatccgtgggttgcggtgcactctactctaactctgtttttagagcatgaggtataaacttgcaaccgtgttaacacgatgcacaccacgcacacactgtatcctctctcttgctagaagcaatgcccatggtttcttttctcgctttgct

SEQ ID NO: 3112 - DNA, 1995 bp, Oryza sativa Japonica Group
ctcctcctcctcctcctcccccatctccggcgccgcgcgccgccgcccggaggagagcttctcgccggtgctgctactgctactaatccccacacccacctgctctcagctcagctcagctcagcttcccagctcggcgaagaagatgaagacgaggagctcggggaggggaggaggggagccgaggaggaggctgaggaatgcggctgtcatggcgctcatgctctcctccctcgtcgctctctccctcgtccgcgccaggttctcccccatcgctagtgatggaggcgaggccctcaagctcaaggccgacgaatccaagctcgtcgtcaccaccaatcacgccgtcgtcaacaccgaatccggcgactcctcctcctcctcgtcgtcggcggctgcggaggaggaggaggaggtcgccgctccggcgaagcccgccgccgccggcggcggcggggccaggccggtgtgctacgagacgagccgccgctccgacacctgcgaggccgccggcgacgtgcgcgtggtggggggcagccagaccgtctacgccgacacgcttgaccgcgagtggaagacgaagccctactgccgtaagcacgacgcgttcgcgctgtcccacgtcaaggagtggacgctcaggccgctcccctccggcgatggcggtggcggtggcgcggcggtggcgccgaggtgcacgacgaacagcacggccacggcgttcgtgctgtcgaccggcgggttcacggggaacccgttccacgactacaccgacgtgctcatcccggcgttcatcaccgcgcaccggttcggcggcgaggtgcagttcctggtgagcagctacaagtcgtggtggatgaacaagtacatccagatcttccagcagatgagccggcacgacgtggtggacgtcgacgctgacggcgacgaggtgaggtgctaccggagcgcggtggtcgggccggagttccacagggagctcggcgtcgacccaaccaagacgccgtcgggctactcggtgctcgacttccgcaagatgctccgcggcgcgttcgggctggaccgcgccacagcgacgccgagcggcgaccggtgggacatccgccgccgaccccgcctcctgatcatctcccgccgcgccgcccgtggccgcgcgttcatgaacgagcgcgccatggcggacatggcggcgagcctgggcttcgacgtgcgtgtcggggagcccgacgcgtccacggacacctccaagtttgctcgcctcgtcaactcctgcgatgtcatggtgggagtgcacggcgccgggctcaccaacatggtgttcctacccgccggcgccgtgctggtgcaggtggtgccatacggcaagctggagtggctggcccggaacaccttcgctgagccgtcgtccgccatggagatccactacctggagtacgccgtgcagcttgacgagacaacgctgagcgagcagtaccccgccgatcacccagtgctgcgagaccctatggccatccacaagcaaggctgggaagctctcaagaccacttacctcgacaagcagaatgtccggccgcatctcggccgcctcaagaacaccttcctccaggccctcaagctgctgccccatgacaaggaaaccatgaattagcttagctcatcagaactgttgatcgtcatggattgtcatcggcaccgtcatcgccatcgccatgccatcgtcatggtgacttgaatttgtggtataaatagatagataggtagctaattttttttcttttttcaaaattattagtattttgtattgatccctagcaagttgccaagatcaggtataatcagtagcttatctgaaataatccgttgcaacgcacgggtatttggcaatgtctatagaaacaatggtgatattgtttgtatgcaccatatttcttaacatatcaagtaagccaaattatcttatactagcagaaacccatattttcatggatttcttcc

SEQ ID NO: 3113 - DNA, 1603 bp, Triticum aestivum
agaggcaggccatgaagtcggccaggagcctgtcgagaggggacgggcggcggctggggaatgcgtcgctcatcgccttcatgctcgcgtccctcgtcctgctctccgtcatcaggacgaggctctcccccatggagaagacgggggacgccatcaaagcagaggagcggcatgggatgagcaagggaagcgtcaaggtggaggtcgcccatgaagctgtggtcacaactccggattcagctgcggaggaggaggaggaggaagaaactccacccaaacccgccgacacgtcgtcccggggtggcgtgagcgtgcccgtgccggtgagcacaagcaccacgcccgtccccgtcgctgtcatagaccgccagggcaagccggtgtgctacgagtcgggccggcggtcggacacgtgcgaggccgccggcgacgtgcgcgtgcagggccgcagccagaccatccaggtccgcccgctggaccgggagtggaaggtgaagccgtactgccggaagcaggacgcctacgcgctgtcgcacgtcaaggaatggaccctccgcccgctctccggcggcggcccgcattgcacggtcaacagctccgcgacggccttcgtgatctccaccggcgggttcaccggcaacctgttccacgactacacggacgtgctggtcccggcgttcatcacggcgcaccggttcggcggcgaggtgcagttcctggtgagcagcttcaagtcgtggtggaccaacaggtacctggagatcttccagcagctgagcaggcacgaggtgatcgacatcgacaacgacgacgaggtccggtgctacgggagcgtggtggtcgggccgacgttccacaaggagctgggcgtggacgcgtccaagacgccgacgggggcgtcgatggtggacttccgcgcgatgctgcggggcgcgttcgggctgtcgcgcgcggcggccgagccaagcggcgaccggtgggacatccggcgccggccgcggctgctcatcatctcgcgcaagaactcgcgcgcgttcctgaacgagcgcgccatggcggacatggccatgagcctcgggtacgacgtgcgcgtgggcgagccggacaccaacacggaggtgtccaggttcgcccggctggtgaactcggcggacgtgatggtgggcgtgcacggcgcggggctgaccaacatggtcttcctccccgccggcgccgtgctgatccaggtgatcccctacggcgggctggagtggctcgcccgcggcaccttcgaggagccgtccaaggacatgcagctgcactacatcggctacaagatccagctcgacgagacgacgctgagcgagcagtaccccaaggaccacccggtgctcactgacccgctctccatccacaagcaggggtgggaggcgctcaagacggtgtacctggagaagcagaacgtgaggccgcacctgggcaggctcaagctcaccttcctggaggcgctcaagctgctgccccatgggcgccaggccaaggccaacaactgagcgcggcaatggccggggccctatctgatcatggatgtaatgatccgatgtgtacattgcgcgcggtcgaa

SEQ ID NO: 3114 - DNA, 1733 bp, Hordeum vulgare subsp. vulgare
gggacggacaaagatttccggtagccgcacccagagagagagagagagagagaggcaggccatgaagtccaccaggaacctggcgagaggcgacgggcggcggctggggaatgcctcgctcatcgccttcatgctcgcgtccctcgtcgtgctctccgtcatccgggccaggatctcccccatggagaaggcaggggaggccatcaaagcagaggagcggcaggggatgaggaaggtgagcgtcaagatggaggtcgcccatgaagccgtactcccaaccgcggattcaactgccaaggaggaggaggacgaggaggaggaagaagaagaagttcggcccaaacccgccgacacctcgtccgggggtgtcgtgcccgtgcccgtgcccgtgcccgtgcccgtgagcacaagcacaagcaccacgcccgtgcccgttgccgccgtgggcctcccgggcaagccggtgtgctacgagtcgggccggcggtcggacacgtgcgaggccgccggcgacgtgcgcgtgcagggccgcagccagaccatccaggtccgcccgctggaccgggaatggaaggtgaagccgtactgccggaagcaggacgcctacgcgctgtcgcacgtcaaggagtggaccctccggccgctctcctccagcggcccggtgccgcattgcacggtcaacagctcagcgaccgccttcgtgctctccaccggcgggttcacgggcaacctgttccacgactacacggacgtgctcgtcccggcgttcatcacggcgcgccggttcggcggcgaggtccagttcctggtgagcagcttcaagtcgtggtggaccaaccggtacctggagatcttccagcagctgagcaagtacgaggtgatcgacatcgacaacgacgacgaggtccggtgctacggtggcgtggtggtcgggccaacgttccacaaggagctgggcgtggacgcgtccaagacgccggcagggtactcgatggtggacttccgcgcgatgctgcggggcgcgttcgggctgtcgcgcgcggcggccgagccgagcggcgaccggtgggacatccggcgccggccgcggctcctcatcatctcccgcaagaactcgcgcgccttcctgaacgagcgcgccatggcggacatggccatgagcctcgggtacgacgtgcgcgtgggcgagccggacagcaacacggacgtgtccaagttcgcccggctggtgaactcggcggacgtgatggtgggcgtgcacggcgccgggctgaccaacatgctcttcctgccagccggcgccgtgctgatccaggtcgtgccctacggagggctggagtggctcgcccgcggcaccttcgaggagccgtccaaggacatgcagctccactacatcggctacaagatccagctcgacgagacgacgctgagcgagcagtaccccaaggaccacccggtgctcaccgacccgctctccatccacaagcaagggtgggaggcgctcaagacggtgtacctcgagaagcagaacgtgaggccgcacctgggcaggctcaagctcacgttcatggaggcgctcaagctgctgccccatgggcgccaggccaaggccaacaactgagcgcggcgatcgccgggcctatctgatcatggatgtaatgatccgtcgaaatcatgtgtacattgcgcgcggtcggtcgatcgatcaattccatgatggttaatcttggagc

SEQ ID NO: 3115 - DNA, 2750 bp, Oryza sativa Japonica Group
ttggcttgcgtcccttttgacgcgctctcatctctgtcctcccttctcttcctatacaagtcctccctttattcttcttcttcctcccctttcttgtagtagtacccttgtttgtgtgttgagccgtggctgtcaccgggtcaacacactaccatttcaacctctttgccctgttcaacaccagctcatgcttccattgctagtggtataagactcggattttccctcatgaaccatccaaatattcagtcttgaagaaggaggagaggggagggggaaggcgatgaagtctaacaggaacctgaccaggggagacggtaggaggctggggaatgcggcactgatagcgtttatgctgggatccctacttgtgctctccctcgtcagggcaaggttctcccccatcgggaagccaggggaagccatcaaaacagaggagcaggaggcgatgaggaaggggagtgtgaagatggagaccctcgaggccgccgatgaggctgcagcatcagctgcagcagcagaagaggaagaagaaacgcagcccaaggctggagacaccacagctggtggcggtggcggtggcgcaagcagcgcagctgttgcagcagcgtccaccacggccacggaccacctgactaagccggtgtgttacgagtcaagccggcggtcggacacgtgcgaggccaccggcgacgtccgcgtgcacggccgcagccagaccatccacatcagcccactggagcaggagtggaaggtgaagccgtactgccggaagcacgatgccttcgcgctgtcgcacgtcaaggagtgggcgcttcggcccctctccaccgccgacacatacccggcggtgccgcattgcacggttaacagttcggccaccgcgttcgtgctctccaccggcgggttcacgggcaacccgttccacgactacacggacgtgctcatcccggcgttcatcaccgcacaccgcttcgctggcgaggttcagttcctggtgagcagcttcaagtcgtggtggacgaacaggtacatgcaaatcttccagcggctcagcaagtacgaattggttgacatcgacaatgatgacgaggtccgatgttaccggagcgtggtggtcgggccgacgttccacaaggagctcggtgtggacgcgtccaggacgccgtcggggtactccatggtggacttccgcacgatgttgcgtggagcgctcgggctggagcgcgctgtggctgagcccagcggcgaccggtgggacatccggcgccgcccacgactgctgatcatctcgcggcgcaactcccgtgcgttcctgaacgagcgtgccatggcggacatggccatgagcctgggcttctacgtgcgtttgggcgagccggacatcagcacggacgtgtccaagttcgcccggctggtgaactcggcggacgtgatggtgggcgtgcacggcgcagggctgaccaacatggtgttcctccctgccggcgccgtgctcatccaggtggtgccgtatggtggcctggaatggctcgcccgcggcacgttcaaggagccggcggccgacatgcagatccactacctcgaatatatgatccagctcgacgagacgacgctgagcgagcaataccccaaggacgacccggtgctcaaggacccctactccatccacaagcagggctggaacgctctcaagatggtctacctagacaagcagaatgtgcggccacatttgggcaggctcaagaacactttcatggaggccctcaagctgctgccccatgggcacaccaactgagtaacatacttattgatcatggagcccaggtaattaccaggaacaccatatcatgtacttaatttgcgtgatcggtcgactagatagtggttgaagatgctaggttctcttcctttggatgtaacaagtctgagtttcaagggtggagtttctcattgatctgtaaatgcgagttaggaggcgcattccctcctctctgtttttctgctctcttgtagtagtattttgggagtagtactacaaaatgtagtttggaggatgtggaatctaataagaatggagggattgcatgggatcagatagaagggtgttggtgattgaacaagagaagagaagagtaccaaaatataatgctatctgttgttagatgtagtagtgtgaaatgtatcaccgatggtctgttttacactatgggtgtgtttagatggtggagaagttggaaagttgggagaaagttggtagtttggagaaaaagttggtactttacgtgagtaggaaagttttcgatgcaatgtgatatgatggcaagttgggaatttgggtggaactaaacacggcctatgcttataaagcgggaccaacgggttacaacaagcgggggttaagggtgaacgacgacgacaggaatccggatgccaagaggttttgtgggagctcactcaccaattcaccatccaaatgcattcctcggtccctgttcttgtaacctgtctcgtctttctggatcgctcttgacacgggctgcacagggattaggatcagttgtagtagttgttatagtgactgcaactttagctgtagccgatttgagtcgttcaaaaggaccggaaggttagctctaaaggcaccaacacgacccaacctgacagactgtagctagccttcaatgtcgttttcttcttcgtctatctttcttcttcctattatcaaaagaagttctcttcttcctctc

SEQ ID NO: 3116 - DNA, 1580 bp, Saccharum officinarum; identical to SEQ ID NO: 3110

SEQ ID NO: 3117 - DNA, 1514 bp, Zea mays; identical to SEQ ID NO: 3109

SEQ ID NO: 3118 - DNA, 1476 bp, Sorghum bicolor; identical to SEQ ID NO: 3108

SEQ ID NO: 3119 - DNA, 1990 bp, Hordeum vulgare subsp. vulgare; identical to SEQ ID NO: 3111

SEQ ID NO: 3120 - DNA, 1995 bp, Oryza sativa Japonica Group; identical to SEQ ID NO: 3112

SEQ ID NO: 3121 - DNA, 1733 bp, Hordeum vulgare subsp. vulgare; identical to SEQ ID NO: 3114

SEQ ID NO: 3122 - DNA, 1603 bp, Triticum aestivum; identical to SEQ ID NO: 3113

SEQ ID NO: 3123 - DNA, 2750 bp, Oryza sativa Japonica Group; identical to SEQ ID NO: 3115

SEQ ID NO: 3124 - DNA, 1392 bp, Sorghum bicolor
tccagtttccccgaggctctagaattcagatccctctcgccacatccgttccctccccctcctctccacgcgcgcgccgccggctctccatctccagcgcgccggcgcccgcccagatccaggagatatgcctcgctatgatgaccgctatggaggcacgcgcttgtatgttggcagattggccccccgtactcgttcccgcgatttagaatatctgttcggcagatatgggagaatacgagaagtggagttgaagcgcgactatgcatttattgagttcagtgatcatcgtgatgctgatgaggctcgataccaactagatggcagggatgttgatgggagtcgcattgttgttgagtttgctaaaggggtcccacgtggtccaggtggctcacgtgaatatatgggaagaggccctccaccaggtaccggtcgttgtttcaactgtggaattgatggtcactgggcaagagactgtaaggctggtgactggaaaaacaaatgctaccgttgtggagaaagagggcatatagaaagaaattgccagaacagtcctaggagtgtcaggcgtgaaagaagttactcacggtccccatctccacgtcgtggaaggggtcgcagtccaagctatagtagaagcaggagcaggagccggagtcggagctatagccgatcgagatccctatctggatctcctaggggaggtcgccgtgaccgtgacgataggagatcaaggagtcttagctacagcaggagccccatgcgatctgcctcgccacctccaaaggaaaaggagcgcagccccacacctgatggaagcaggagcccaaggagtcgcagcccccaggatcaggtgatgagcccaccaccaaaggataacggcgaaggcaatggttcagaccgtggcgagagccccagaggaagggaaactagcaggagcaggagccgcagcaggagcccatccggtgataaccgcagccctgcagctaatgggcggagcccgagtcctagaggtgaccgtagcccaagccccagggctgaccgtagcccaagccccaaggctgaccgtagcccaagccccaagggcaatggtaacaatgacgatgatgatgctgcccgtggtgcttccccagcaggaagcaagtcaccctgaaagatgcccatcccagtttgtgctgcttcatgatgcaatggacagactttatcgtcattgctgtttttattatcacataccaaagacatgcatctttctcctatctgaaacgtggacttattttgtttgctttgagctaggactcgtatttttctcttatggatatgatatgatgccttcgggctggtttgcatctgaataagtggatgttcgcatgttgtgtaccatgttgatattat

SEQ ID NO: 3125 - DNA, 1369 bp, Zea mays
aaccgcctccggcttcagttccccgaggctagaattcggatccctcccaccacatccatccccttcccttcccttccctcgtgccccgccggctctccagcgcgccgtctctgcccagatccaggagatatgcctcgctatgatgatcgctatggaggcacgcgcttgtatgttggcagattggccccccgtactcgttctcgtgatttagaatatctcttcggcaaatatggaagaatacgagaagtggagttgaagcgcgactatgcatttattgagttcagtgaacatcgtgatgccgatgaagctcggtaccaactagatggcagggatgtcgatggaagtcgcattgttgttgagtttgctaaaggggtcccacgtggtccaggtggctcacgtgaatatatgggaagaggccctccaccaggcacaggtcgttgtttcaactgtggaatggatggtcactgggcaagagactgtaaggctggtgactggaaaaataaatgctaccgttgtggagaaagagggcatatagaaagaaattgccagaacagtcctaggagcgtcaggcgtgaaagaagttactcacgctccccatctccacgccgtggaagaggtcgcagtccaagctatagcaggagcaggagccggagccggagccggagctatagccgatcgaggtccctatctggatctcctaggggaggccgccgtgaccgtgatgataggagatcgaggagtcttagctacagcaggagccccatgcggtcgccacctgcaaaggaaaaggagcgcagtcccacacctggcggaagcaggagcccaaggagccgcagcccacaggatcaggtgatgagcccaccacctaaggataacggcgacaggaatggttcagaccgtggcgacagccccagagggagggaaaacagcaggagccgcagccgcagccgcagcccatccggtggtaaccgcagccctgcagctaatgggcgtagcccgagccccagaggtgaccgtaccccgagccccatggctgaccgtagcccgagcccaaagggcaatggtaacaacgatggtggtgatgatgatactggccgtggtggttcccccacaggaagcaagtcaccctgaacgctgcaccgtctcagttcttaggtgcttcgtgatgcagtgggcaaacataccaaagacgtgatagctgtatcgtttccctatctgagacgtggacttatttagcttgctttgatattggtgtcttatttctcttatgaataatgtggacacgcatgttgtgtcgccctatgttggtatttacctgcaatgctatagcgtcagtcttgttgaggcctgagcaaaaaaaaaaaaaaaa

SEQ ID NO: 3126 - DNA, 1303 bp, Oryza sativa Japonica Group
cgtctcctcgcgagttcacccgcccgccgcctgcggcgatctccatccagcgagcagcggcgccggcgccggcgtaccgctgcttccgccgcatcctctatctctggagatgcctcgctatgatgatcattatggaagcacacgcttgtatgttggtagactgtcttcgcgcactcgttctcgtgacctagaatatcttttcggcagatatggaagaatacgtgaagtggagttgaagcgcgactacgcgtttattgaattcagtgatccccgtgatgctgatgaagcgcggtataacctagatggcagggatgttgatggaagccgcattcttgttgagtttgctaaaggagttccacgtggtgctgctggtggttcacgtgaatatatggggagaggacctcctccaggaacaggtcgctgttttaactgtgggattgatggtcactgggcaagagactgcaaggctggtgactggaagaacaaatgttaccgttgtggagaaagaggtcacatagaaagaaactgccaaaacagtccaagaaatctcaggcgagagagaagttattcgcgctccccatcgccacgccgtggacgtggtcatggtcgtagtcgtagctatagccggagccggagcaggagttacagccgatctaggtccagatccctatctggatctcccaggggacgcagagatcgtgatgataggagatcaaggagtcttagctacagcagaagtcccaggcgatccatctccccagcagcaaatggaaaggagcgcaaccccagcccgaatggtaggcggagtccaaggagtccacaggatcgggtaagcccaccacccaaggataatgatgagcgcaatggtgacagcccctggggcagggagaacagcaggagcccatctgacggctaccgtagccctgtggctgccaatgggcgcagcccaagcccaaggaacaatggaagccctagtccaatggacaacaatagccgaagcccaagggacaacggcagcccgagccctagggatggaaatggtgatggtggtagccgtggcggctcacgctcgcccagagcaagcgagtcccctgaagcttgaaatttaatcccagtctctggcgttcatcttgtggatggtcatgctatggttgtaatagttatatttccggtttaagacgagatcaaggagtcttaacacctgaaaggatttggtgcccttggggctatgctatattgctattggtgtgtaatggatcgatgaactttctattagcctgcattgtttttgcggtctggtatc

SEQ ID NO: 3127 - DNA, 1238 bp, Zea mays
cagagcaaccctatctcttccccactccgctcctcgctcaccctctcaccaaatccttctcctccgcgccgccacagccgggcgcgcctctcgatcgagatccaggagatatgcctcgttatgatgatcgccatgggaatacacgcttgtatgttggaagattggcccctcgcacccgttcccgcgacctagaatatcttttcagcaaatatggaagaatacgtgaagtggagttgaagcgtgactatgcattcattgaattcagtgacccccgtgatgctgatgatgcgcagtacaacctagatggcagggaagtcgatggaagccgtattattgttgaatttgctaaaggagttcctcgtggttctggtggttcacgtgagtacatgggaagaggacctccaccaggaacaggtcgttgttttaactgtggaatggatggtcactgggcaagggactgcaaggctggtgactggaagaacaaatgctaccgctgtggtgaatcgggccatatagagagaaattgccagaacagtccaaggaatctcaggcgtgataaaagctattcacggtctccatccccacgtggtggacgtggccgcagccggagctacagcagaagccggagctatagccgatccagatccccatctggatctcccaggggtggacgccgtgaacgtgacgagaggagatctaggagtcttagctacagcaggagcgcaagccccaggcgttctgtctcacctgcaaaggaaaaggagcgcagtcgcacacccaatggcagtaggagcccaaggagccccagcccaagggctgaggtgagcccaccactgaaggataatggtgcacgcaatggctcagaccatgaaggcaaccctggtggtggagagaacagcaagaggagtcggagcccatctgatggctaccgtagccctgtggccaatgggcgcagcccgagcccgagggacgatcggagcccaagccccaagggcaacaacgaagatgacgagcgccgtggttcacctagaggaagtcagtcccccctgaactgagaaattctgatcaaatttgggccgcacgattcggttgtaactgttatattttagtttgagacaacaaactgtatttgctcatttctcatacagtcaggtttatgctttttgagctagaaaacatgtgtaagaatttgttaccttcaagctattcctggtttgtgatatggtaatacttgaact

SEQ ID NO: 3128 - DNA, 1255 bp, Triticum aestivum
ccgcagcgtccgacctagggttctgcgccgccgccgccccgctgctcccgaggagatgcctcgttatgatgatcgttatggaaatgcacgcttgtatgttggtagattgtcctcccgtactcgttcgcgtgacctagaatatcttttcagcaaatatggaagaatacgggaagtggaattgaagcgcgactatgcattcattgaatacagtgatcctcgtgatgctgatgaggcccgatacaacctagatggcagggatgttgatgggagccgcattattgttgagtttgctaaaggggttccacgtggttctggtggttcacgagaacgtgaatatgtgggaagagggcctcctccaggaacaggccgttgtttcaactgtggtattgatggtcattgggccagggactgcaaagctggtgactggaagaacaaatgctaccgctgtggagaaaggggccatattgaaagaaattgccagaatagcccgaggagtctcaggcgtgagagaagctattcacggtccccatctccacgtcgtggacgggctcgcagtcggagctacagcagaagccgtagttacagccgatctaggtccagatcctattctgaatctcccagagggcgccgcacagagcgtgatgagaggagatcaaggagcattagctacagcaggagccccaggcgatcactctccccaggaggcaaggaaatggatcgcagccccacacctgatcgcagtcggagccccaggcgatccatctcacctgtagcaaaggataatggtgatagccctcggggcagggagacaagcaggagcccatctgatggctaccgtagccctgtggccaatgggcgcagcccaagaagccctgttaacaatggcagtcccagtcctaccagagacaacagggccagtccaagcctgaggggcaacaacggtagccctagtcctaagggcaatggcaacggtggcagcccaagtccaaggggcaatggtgacgacgatggacgtcgaggctcaggctcacctagaggaagaagcgtgtctccatgaaacgtggaaccattttccagtttctgctcgctacatgtggttgtgacagtacatttcaagtttaagacgtgttgtcagtgaatttcctacctgtttcctgaatctgttgtttagttcctggacgcctcgaaggtttgttactctggttatgctgtgcgtaatggattgataatgctattgagtagcataagaattaaa

SEQ ID NO: 3129 - DNA, 1245 bp, Sorghum bicolor
acttgctggttcccgctccctcttatcgcctccgcgctctaatggcctcacaccccaccacgcagtaaacgaaacgacgggcccactccccgacggctgacgccctcccacgcccccttccatgaggcagccgcacctctcgccgcagctctccccttccccggtcctctcctcccacttctcgccgccggcgacgggggcctcgccctggcggcggcggctgcaccgggggcgggccttccaaccgccgctctcctcgctgcgggagcccaacaaggccacgctccgcaaggcctcgcccaacgtacccttccgcctcggcggtggcggtggcgggagcggcagccccaaggaccgccgccccgccgccgacgacaaggaggaggaggccgagggcagcggcggcggcggcggcgccggggcactcacagggacgctgatcgcgggagcgctactggttggtttcgtaggggggtttggggcggccggatacgtgtacaaggaccagatcaacaccttcctcacgcagttctcagggtttattgacggctatggtccagccggatacgctctgttcgtacttgtatatgcagggttggaggttctcgcaattcctgcaatacctttaaccatgtcagctggtctgttgtttggtaatgtgaccggtacaattattgtctcagtcggtggaacactagctgcagccgtggccttccttattgctagatactttgccagagagagaattcttaaaatggttgaaggaaataagaagtttctggcaattgataaggcaataggtgaaaatggatttaaggtcgttactttgcttcgtttgagtcccctgttacctttctcccttgggaactatctgtatggcctgacttcagtgaagttcttgccatatgtcttgggcagttggttgggaatgcttccaggttcatgggcttacgtcagtgctggtgcattcgggcgagctataattcaagatgagtcggaaattggtttgggaggaaatggacagctatggacactgggtgttgggttattgtttacagccattgctgccacttatgtaacaaggctcgcaaaggatgctgtaaaggagatcgacgactagaatggtaggattctctagtagaaagggccctctggagcctggatagtatactagcacattgtacatcactggcacctttggtgcaattcaaatctaatagaagttcagagcaattttctggaggg

SEQ ID NO: 3130 - DNA, 1185 bp, Zea mays
aaccgcgccacgcagtaaacgaaaagacgggcccactccctcaatcctccgcacgccccttccatggggcagccgcacctcttgccgcagctctccccctccccggtcctctactccctcttctcgccgccggagacgggggccacgccctggcggcggccgctgaaccggggacgggccttccaaccgccgctctcctcgctgcgggagaccaacaaggccacgctccgcaaggccacgcccaacgcccccttccgcctcggcggtggcgggggcggcagccccaaggatcgccgccccgccgccgacgacaaggaggacgaggacgagggtcgcggcggcgccggggcactcacagggacgctgatcgcaggagcattactggttggtttcgtaggggggtttggggcggccggttacgtgtacaaggaccagatcaacaccttcctcacgcagttctcggggttccttgacggctatggtccagccggatatgctctgttcgtacttgtatatgcagggttggaggttctcgcaattcccgcaatacctttaaccatgtcagctggtctattatttggtaatgtgactggtacaattattgtttcagtcggtggaacgctagctgcagcggtggccttccttattgctagatactttgccagagagagaattcttaaattggttgaaggaaataagaagtttctggcaattgataaggcaataggtgaaaatgggtttaaggttgttactttgctacgcttgagtcccctgttacctttctcccttgggaactatctatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgtaacgaggctcgcaaaggacgctgtaaaggagatcgacgactagaatggtaggattctctaggagaaagggccatctggatagtgtactagcctagcacattgtacatcactggcacctttggtgcgataaaatcttatagaaagccagagcaattttatgaggtgaaaaaaaaaaaaaaaa

SEQ ID NO: 3131 - DNA, 1323 bp, Zea mays
ctctccttcctctctcttctccagcgccttccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacgggccttccaaccgccgctctcctcgctgcgggatcccaacaaggccacgctccgcaaggcctcgtccaacgtccccttccgcctcggcggtggcgggagcggcagccccaaggaccgccgccccgccgacgacgacaaggcggaggaggaggccgagggcgagggcggcgcaggggcactcacggggacgctggtcgcaggagcgctactggttggtttcgtaggggggtttggggcggccggatacgtgtacaaggaccagatcaacaccttcctcacgcagttctcagggttcattgacggctatggtccagccggatatgctctgttcgtacttgtatatgcaggattggaggttctcgctattcccgcaatacctttaaccatgtcagctggtctattatttggtagtgtgaccggtacaattattgtttcaatcagtggaacactagctgcagcggtggccttccttatcgctagatacttcgccagagatagaattcttaaattggttgaaggaaataagaagtttctggcaattgataaagcaataggtgaaaatggattcaaggttgtcactttgcttcgtttgagtcccctgttacctttctcccttggtaactatctatatggcctgacttcagtgaagttcttgccatatgtcttgggcagttggttgggaatgcttccaggttcatgggcttacgtcagcgctggtgcattcgggcgagctataattcaagaggagtcggaaattggttggggaggaaatggacagctatggacattgggtgttgggttattgtttacggccatggctgccgcttatgtaacaaggctcgcaaaggatgctgtaaaggagatcgatgactagaatagtaggattctctagtagaaagggccctctggagtctgatagtatactagcacatcgtacatcactggcacctttggtgcaatcaaatctaatagaaattcagagcaattttctgagtgaaaaaaaaaaaaaaaaaaaaaaaaaaaaaaaaaaaaaaaaaaaaaaaaaaaataaaaaaaaaaaaaaaa

SEQ ID NO: 3132 - DNA, 1254 bp, Zea mays
ctcttctccagcgccttcccctgctccctcttatcgccttcgcgctctaaaatggcctcacactccgccacacagtaaacaaaacgacgggcccactccccgacggctgacgccctcccacggccccttccatgaggcagctgcacctctcgccgcagctctccccctccccggtcctctcctctcacttctcgccgccgccggcggaggccttgtcctggcggcggcggctgcaccggggacgggccttccaaccgccgctctcctcgctgcgggatcccaacaaggccacgctccgcaaggcctcgtccaacgtccccttccgcctcggcggtggcgggagcggcagccccaaggaccgccgccccgccgacgacgacaaggaggaggaggaggccgagggcgagggcggcgcaggagcactcacggggacgctggtcgcaggagcgctactggttggtttcgtaggggggtttggggcggccggatacgtgtacaaggaccagatcaacactttcctcacgcagttctcagggttcattgacggctatggtccagccggatatgctctgttcgtacttgtatatgcaggattggaggttctcgctattcccgcaatacctttaaccatgtcagctggtctattatttggtagtgtgaccggtacaattattgtttcaatcagtggaacactagctgcagcggtggccttccttattgctagatacttcgccagagagagaattcttaaattggttgaaggaaataagaagtttctggcaattgataaagcaataggtgaaaatggattcaaggttgtcactttgcttcgtttgagtcccctgttacctttctcccttgggaactatctatatggcctgacttcagtgaagttcttgccatatgtcttgggcagttggttgggaatgcttccaggttcatgggcttacgtcagcgctggtgcattcgggcgagctataattcaagaggagtcggaaattggttggggaggaaatggacagctatggacattgagtgttgggttattgtttacggccatggctgccgcttatgtaacaaggctcgcaaaggatgctgtaaaggagatcgatgactagaatagtaggattctctagtagaaagggccctctggagtctgatagtatactagcacatcgtacatcactggcacctttggtgcaatcaaatctaatagaaattcagagcaattttctgagtgaatttgatctcttg

SEQ ID NO: 3133 - DNA, 1181 bp, Hordeum vulgare subsp. vulgare
ggcgcgttaagcaagccgcgccgcgccccctggcctgacagcccgaccccatgaggcagccgcacctcctctcgccgcagcagctctccccctcgcccgtcctctcctcccacttctcgccgccctgcgcggcgcggggctgctcgccgtggcggtggcgccaccgccgggccttccacccgccgctctcctcgctgcgggagtccgacaagggcacgctgcgcaaggcctcgcccaacctccccttccgcttcggtggcggcgggggcggccccagccccgacgaccgccgctccgccgcagaccaggagaagaagaaggggaaggaggaggaggaggaggagggcggcggggtctcgggggccctcaccgggactctgctcgccggggctgtgctggtcggggtcgtaggggggttcggggccgccgggtacgtgtacaaggaccagatcaataccttcctcacgcacttctccgggttcattgagggctatggcactgctgggtacgcgttgtttatacttgcctatgcaggattggaggttcttgcgattccagcagtaccgttgaccatgactgcaggtctattattcggtagtgttactggtactattatggtttcaatcagtgggacactagctgccgctgtggcctttctcatcgctagatactttgctagagagcgtattcttaagatggttgaaggaaacaagaagtttctggcgattgataaagcaatcggtgaaaatggattcaaggttgtgaccctgcttcgtttgagtcccctattacctttctcccttgggaactacctgtatggcttgacttcagtcaagttcataccctacgtgttgggcagttggttgggcatgcttccaggaacatgggcctatgtcagtgctggtgcatttgggcgagctataattcaagatgagacggaaatcggtttgggaggaaacaaccagctattgacactgggcatagggctattagttacagccgttgctgctacttatgtaacacggcttgcaaaggatgctgtaaaggatattgacgacgaatagaatggtaggattacatagcaaaagggccattcaaatagcaaaagtagcacgagaatgtacatcactggcatcttttggtgcaatctaatctagaaatacaagcggttgtcggagagg

SEQ ID NO: 3134 - DNA, 2664 bp, Oryza sativa Japonica Group
gtcctcctcctcctcctctcttccatcgccgctgctcgcttcctccccctctcccacgaaagatggcgtctcacattgttgggtacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtacatccccagcaacaccttctcgtactatgatcaggttcttgacacggctgccatgcttggtgctgtcccagagcgctactcatggactggtggagagattgggttcagcacctacttctcgatggctaggggcaatgccactgtccctgccatggagatgaccaagtggtttgacaccaactaccactttatcgtccctgaacttggtcccaacaccaagttctcctactcttcccacaaggctgtgaatgaatacaaggaggctaaggcgctcggcgttgacaccgtgccagtacttgttggaccagtttcatacttgttgctctccaaacctgccaagggtgtagagaagtcgttcgctcttctttcccttctgagcagcatccttcctgtctacaaggaggttattgctgagttgaaggcagctggtgctacttggattcagtttgatgaacccacacttgttcttgaccttgactctcaccaattggctgcattctctgctgcatacacagaacttgagtcggcactttctggattgaatgtgcttattgagacatacttcgctgacattcctgctgaatcatacaagaccctcacatccctgaacagcgtgactgcttatggttttgaccttatccgtggagccaagactcttgaccttatcaagagtgctggtttcccctctggaaagtacctctttgccggtgttgtggatggacgcaacatctgggctgatgatctcgctgcatctctcactacccttgagtctcttgaggctattgttggaaaggacaagcttgtggtctcgacttcctgctcactcatgcacaccgctgtggatcttgtaaatgagaccaagctcgatagcgagattaagtcatggctcgcttttgctgcccaaaaggtggttgaggtgaatgcccttgctaaggcattggctggacagaaggatgaggcttactttgcagcaaacgctgctgctcaggcctccaggaggtcatcacctcgtgtgacaaacgaggaagtccaaaaggctgctgctgctctgaaggggtctgaccaccgccgtgctaccaatgttagcgctagactggacgcacagcagaagaagctcaaccttccagtccttcctacaaccacaattggttcattcccacagactgtggagctcaggagagtccgccgtgagtacaaggcaaaaaagatctctgaggaggagtacatcagtgccatcaaggaggaaatcagcaaggttgttaagatccaggaagagcttgacatcgatgtccttgttcacggcgagcctgagagaaacgatatggttgagtacttcggtgagcagctttctggttttgcattcactgccaacggatgggtgcaatcttatggatcacggtgtgtcaagccaccaattatctatggtgatgtgagccgccccaaccccatgactgtgttctggtccaagttggcgcagagcatgacctctcgccccatgaagggaatgttgactggtcccgtcacaatccttaactggtcttttgtcaggaatgaccagccgaggtttgagacatgctaccagattgctcttgccatcaagaaggaggtcgaggaccttgaggctggtggtattcaggtcatccaaatcgatgaggctgctttgagagaaggtctgccactccgcaaggcggagcatgctttctacttggactgggctgttcactccttcagaatcaccaactgcggtgttcaggacaccacccagatccacacccacatgtgctactctaacttcaacgacatcatccactccatcatcaacatggacgctgatgtgatcaccatcgagaactcccggtccgacgagaagctgctctccgtcttccgcgagggtgtgaagtatggtgctggcattggccctggtgtctatgacatccactccccaaggatcccgtccacagaggagattgcggaccgcgtcaacaagatgctcgcggtgctcgacactaacattctctgggtgaaccctgactgcggtctcaagacccgcaagtacaacgaggtcaagcccgcccttaccaacatggtttcggccgccaagctcatccgcacccagctcgccagcgcgaagtgaggatatccatagctgcaagttcccttcggttgcgaggacgatgccgtcatagccatctgtttttgaataatctgggtccagtggatccaattgtctgtggttaggtttagtcagtctcggtgggaagatccctcatacccgttttacttttgaatcaatttggtggtttttgaggcagtttgtcggtgtatttgtattgtgtgtaatctgagtgggaatcagcagtgtttcatctgcatctgaatcgttgcggatcaaattacaaaattttcaaggagagttcttgatgttatggtcttcc

SEQ ID NO: 3135 - DNA, 2626 bp, Oryza sativa Japonica Group
gtcctcctcctcctcctccctcgccgtccgccgccgccgctcgcttcctcccctctcccacgaaagatggcgtctcacattgttggatacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtatatccccagcaacaccttctcgtactatgatcaggttcttgacacgaccgccatgcttggtgctgtcccagagcgctactcatggaccggtggagagattgggttcagcacctacttctcgatggctaggggaaatgccactgtccctgctatggagatgaccaagtggtttgacaccaactaccactttatcgtccctgaacttggtcccaacaccaagttctcctactcttcccacaaggctgtgaatgaatacaaggaggccaaggcgctcggcgttgacaccgtgccagtacttgttggaccagtttcatacttgttgctctccaagcctgccaagggtgtagagaagtcgttcgctcttctttcccttctcagcagcatccttcctgtctacaaggaggttattgctgagttgaaggcagctggtgctacatggattcagtttgatgagcccacacttgttcttgaccttgactctcaccaattggctgcattctctgcagcgtacacagaactcgagtcggcactttctggattgaatgtgcttattgagacatacttcgctgacattcctgctgaatcatacaagaccctcacatccctgaacagcgtgactgcttatggttttgaccttatccgtggttccaagactcttgaccttgtcaagagtgctggtttcccctctggcaagtacctctttgctggtgttgtggatggacgcaacatctgggctgatgatctcgccgcatctctcaccaccctcgagtctcttgaggctattgttggaaaggacaagcttgtggtctcgacttcctgctcactcatgcacaccgctgtggatcttgtaaatgagaccaagctcgatagcgagattaagtcatggcttgcttttgctgcccaaaaagtggttgaggtgaatgcccttgctaaggcattggctggacagaaggatgaggcttactttgcagcaaacactgctgctcaggcctccaggaggtcatcacctcgtgtgacaaacgaggaagtccaaaaggctgctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagatctctgaggatgagtacgtcagtgccatcaaggaggaaatcagcaaggttgttaagatccaggaagagcttgacattgatgtgcttgttcacggcgagcctgagagaaacgatatggttgagtactttggtgagcagctttctggttttgcatttactgccaatggatgggtgcaatcctatggatcccggtgtgtcaagccaccaattatctatggtgatgtgagccgccccaacgccatgactgtgttctggtccaagatggcgcagagcatgacctctcgccccatgaagggaatgttgactggtcccgtcacaatccttaactggtcttttgtcaggaatgaccagccgaggtttgagacatgctaccagattgctcttgccatcaagaaggaggtcgaggaccttgaggctggtggtatacaggtcatccaaatcgatgaggctgctttgagagaaggtctgcccctccgcaaggcggagcatgctttctacttggactgggctgttcactccttcagaatcacaaactgcggtgttcaggacaccacccagattcacacccacatgtgctactctaacttcaacgacatcatccactccatcataaacatggacgccgatgtgatcaccatcgagaactcccggtccgacgagaagctgctctctgtcttccgcgagggtgtgaagtatggtgctggcattggtcctggtgtctacgacatccactcccccaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtgaggatcgcctttgcagcaagttcccttcgattttgaggaggaatgccatcatagccatcttgtttttgaataatctgggtccagtggatccactgtctgtggttaggtttagtcagtctcttggggccaagatcactcatacccattttactttgaatgaatttggtggtttttgaggcagtctgtcggtgtatttgtattgtaaactgagtggaaatcagcagtgtttcatctacatctgagttgttgcggatcaaatt

SEQ ID NO: 3136 - DNA, 2579 bp, Zea mays
cgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgcggtacctgttttactactctctgtttggtggtttctgaggaagttgcccgtgtacttgtatcgtaaaaaccgagtgggacatctgcatcgtttcatct

SEQ ID NO: 3137 - DNA, 2300 bp, Zea mays
atggcgtcacacatcgttggataccctcgcatgggccccaagagggagctcaagtttgcactcgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcggggatcttaaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagttcgccagcgccaagta

SEQ ID NO: 3138 - DNA, 2621 bp, Zea mays
cacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcagcgccgaggatttggagaaagttgccactgacctgaggtctagcatctggaagcaaatgtcagaagctgggatcaagtacattcccagcaataccttctcgtactacgaccaggttcttgataccacggccatgcttggcgctgtcccagagcgctactcttggactggaggcgagattggcttgagcacctacttctctatggccaggggaaatgccactgtccctgccatggagatgaccaagtggtttgatacaaactaccactttattgtccctgaacttggtccaagcaccaagttcacatacgcttctcacaaggctgtttctgagtacaaggaggcaaaggcgctcggcattgatacagtcccagtgcttgttggaccagtctcatacttgctcctctctaagcctgccaagggtgtggagaaatctttctctcttctttcacttcttggtagcattcttcccatctacaaggaggttgttgctgagctgaaggcagctggtgcttcatggattcagcttgatgagcctacccttgttaaagaccttgatgctcacgaattggccgcattctcttcagcatatgctgaactggagtcatcgttctctggattgaatgtgcttatcgagacatacttcgctgatattcctgctgagtcctacaagaccctcacatcattgagtggtgtgactgcttacggtttcgatcttatccgtggagccaagacccttgatcttatcaggagcagcttcccctctgggaagtacctcttcgctggtgttgtagatggacgcaacatttgggctgatgatcttgctgcatctcttagcactcttcattctcttgaggctgttgctggcaaggacaaacttgtggtgtcaacctcctgctcactgatgcacaccgctgttgaccttgtaaatgagactaagctggatgatgagattaagtcatggcttgcatttgctgcccaaaaggttgttgaggttaatgcccttgccaaggctttggcaggccaaaaggatgaggtctactttgcagccaatgctgctgctcaggcctcaaggagatcatcgcccagggtgacaaacgaggaggtccagaaggctgcagctgctttgaggggatctgaccaccgccgttctaccactgtttctgctagattggatgctcagcagaaaaagctcaaccttcctgtccttcccacaaccacaattggttcattccctcagactgtggaactcaggagggttcgccgtgaatacaaggcaaagaagatcaccgaggacgaatacatcagtgccatcaaggaagaaatcagcaaggtcgtcaagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctacggtgatgtcagccggccgaaccccatgactgttttctggtccaagatggcacagagcatgacccctcgtcccatgaagggaatgttgactggtccggtcacaatcctcaactggtcattcgtcaggaacgaccagcctaggtttgagacatgctaccaaatagctcttgcaatcaaaaaggaggttgaggatcttgaggctgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgacatccactctcctaggattccctccacagaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgaggtcgtttgatagctccatggtctgatagcgcggaatgagccagttgttttgaataatttgggtgttaccccctgttccatggtgttagtgttaggttagcctctcattggtgagatacgccgtttcaagatgtgttctaagtttggagtgtgtgttttcctttgggctatgtttctgggggtatgtgtgtgctttggttataaacagaaatgaaatatgcagtcttcc

SEQ ID NO: 3139 - DNA, 2675 bp, Zea mays
ctctacaaatgaaacccctgagacagtcagacgtcccgtgctcgtcatcaccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccaggtccttgataccacggccatgcttggtgctgtcccagagcgctactcttggactggaggcgagattggcttgagcacctatttctcaatggccaggggaaatgccactgtccctgctatggagatgaccaagtggtttgatacaaactaccactttattgtccctgaacttggcccaagcaccaagttcacatacgcttctcacaaggctgtttctgagtacaaggaggcaaaagcgctcggtattgatactgtcccagtgcttgttggaccagtgtcatacttgctcctctctaagcctgccaagggtgtggagaaatctttctctcttctttcgcttcttggcagcattcttcccatctacaaggaggttgtttctgaactgaaggcagctggtgcttcatggattcagtttgatgagcctacccttgttaaagaccttgatgttcacgaattggcagcattctcttcagcatatgctgaactagagtcggcattctctggattgaatgtgcttatcgagacatactttgctgacattcctgctgagtcctacaagaccctcacgtcattgagtggtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcactgatgcacaccgctgttgatcttgtcaatgaaactaagctggatgatgagattaagtcatggcttgcatttgctgcccaaaaggttgtcgaggttaatgcccttgcgaaggctttggcaggccaaaaggatgaggcttactttgcagccaatgctgctgctcaggcctcaaggagatcatcacctagagtgacaaacgaggaggtccaaaaggctgcagctgctttgaagggttctgaccaccgccgtgctaccactgttgctgctagattggatgctcagcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagaaagaaatgacatggttgagtacttcggtgagcaattatctggttttgcattcactgccaacggatgggtgcaatcttatggatcacgttgtgtgaagccacccattatctatggcgatgtcagccggccgaaccccatgactgttttctggtccaagacggcacagagcatgaccgctcgtcccatgaagggaatgttgactggtccagtcacaatcctcaactggtcatttgtcaggaacgatcagcctaggtttgagacatgctaccaaatagctcttgcaataaaaaaggaggttgaggatcttgaggctgctggtattcaggtgatccagattgatgaggcagctctaagggagggtctgccactgcgcaagtcagagcatgcattctacctggactgggctgtccactctttcagaatcaccaactgcggagtccaggacaccacccagatccacacccatatgtgctactccaacttcaacgacatcatccactccatcatcgacatggacgcagatgtgatcaccatcgagaactcccggtccgacgagaagctactgtccgtgttccgcgagggtgtgaagtacggagctggaatcggtccaggtgtctacgacatccactcgcccaggatcccctccaccgaggagatcgcggaccgcgtcaacaagatgctcgccgtgctcgacaccaacatcctctgggtgaaccctgactgcggtctcaagacacgcaagtacacggaggtgaagcctgccctgaccaacatggtctccgccaccaagctcatccgcacccagctcggcagcgcgaaatgagtcagatttggtagatccatggtttgttgaacacaaaagccagcagggtcatttgtttcgaataatttgggtccttactcctgttccatggcgttaggttagcctcattggtgttggtggggtacggcgttacgtgtccgtgttctaagtttggagtgtgtgtttctcttttttgttggggtttgtgtgctttggttatataaacagaaatggagtacgcagtcttcgaatcgcaaaaaaaaaaaaaaaa

SEQ ID NO: 3140 - DNA, 2675 bp, Hordeum vulgare subsp. vulgare
gctctgcctcccactctatcgtcttcctcctcatctccggcgccactccgccgcccctcgactcctccaaggaccaacgaaagatggcgtcccatattgttgggtaccctcgcatgggccccaagagggagctcaagtttgccttggagtctttctgggatgggaagagcagcgctgaggatctggagaaggttgccaccgacctcagggccagcatctggaagcagatgtcagaggctgggatcaagtacattcccagcaacaccttctcatactatgaccaggtgcttgacacaacggccatgcttggtgctgtcccggaccgctactcatggactggcggagagattggccacagcacctacttctcaatggccagaggcaatgccactgtccctgctatggagatgaccaagtggtttgacaccaactaccacttcattgtacctgaattgagcccagcaaccaagttctcatatgcttcacacaaggctgtctctgaatacaaggaggcaaaggcgcttggtgttgacacggttccagtgcttgttggaccagtctcatacttgctgctctctaaggcggcgaagggtgtggagaaatcattctctcttctttcacttcttgatagcattcttcccatctacaaggaggttgtggctgagctgaaggcagctggtgcttcatggattcagtttgatgagcccacccttgttaaggaccttgctgctcatgaattggccgcgttctcttcagcatatgctgaacttgaatcagcactctctggattgaatgtccttattgagacatactttgccgatgttcctgctgaatcttacaagaccctcacatcattgagtggcgtgactgcctatggttttgatcttgttcgtggaactaagacagttgagcttatcaagagcacgggtatcccatctgggaagtacctatttgctggtgttgtagatggacggaacatttgggctgatgatcttgctgcatctctcagcactcttcagtctcttgagtctgttgttggcaaggacaaacttgtggtgtctacctcctgctcactgatgcacactgctgttgatcttgtgaacgagaccaagctcgacagtgagatcaagtcatggctcgcatttgctgcccaaaaggtggttgaggtgaatgcccttggcaaggctttggctggtcaaaaggatgaggcctactttgcggccaatgccgctgctcaggcctcaaggaggtcgtcacccagggtgaacaatgaggaggttcagaaggctgcggctgctttgaagggatctgaccaccgccgtgctacccctgtttctgctagactggatgctcagcagaagaagctcaaccttcctgtccttccgacaacgacaattggttcattccctcagacaatggacctcaggagggtccgccgtgagtacaaggcgaagaagatctctgaggaggactatgtcagtgctatcaaggaagaaattagcaaggttgtcaagatccaagaggagcttgacatcgatgtgctcgtccatggagagcctgagagaaatgacatggttgagtactttggcgagcaactatctggttttgcatttactgccaatggatgggtgcaatcctatggatcacgttgcgtgaagccaccgatcatctatggtgatgtcagccgccccaaccccatgactgtcttctggtccaagatggctcagagcatgacccctcgcccaatgaagggaatgttgactggcccagtcacaatcctcaactggtcttttgtcaggaacgaccagccaaggtttgagacatgctaccagattgctcttgccattaaaaaggaggttgaggatcttgaagctggtggtattcaggtgatccagatcgacgaggctgctctaagagagggtctgccactgcgcaagtcggagcatgctttctacctggactgggccgtccactcgttcagaatcaccaactgcggtgtgcaagataccactcagatccacacccacatgtgctactccaacttcaacgatatcatccactccatcatcaacatggacgccgacgtcatcaccattgagaactcacggtccgacgagaagctcctctcggtcttccgcgagggcgtgacctacggggccggcattggccccggcgtctacgacatccactcccccaggatcccctccacggaggagattgccgaccgcgtcaacaagatgctcgcggtgctcgacaccaacatcctctgggtgaaccctgactgcggcctcaagacccgcaagtacaccgaggtgaagcccgccctgactaacatggtcgctgcggccaagctcatccgcacccagctcgccagcacgaagtgaggagccatgaaatcgaacagcctgatgatactactacctattgttttgtggggacagagcgccaaacgagccgtttgtttcgaataatccgattctttatcgtaccgcccgagtctggctagggttagtcctgctgttatggtaaaactgttacatgttgatggcatacgttgtattctatgtgtttggtgggtggtctcattgtttacaggttgtgtggtcttgtcgcggttataaacagagttgaatgaaaaaaaaaaaaaaaaaaaaaaaaaaaaaaaaaaaaaaaaa

SEQ ID NO: 3141 - DNA, 2601 bp, Hordeum vulgare subsp. vulgare
ggtgcccaccgccatcctcctctgcctcccactctatcgtcttcctcctcatctccggcgccactccgccgcccctcgactcctccaaggaccaacgaaagatggcgtcccatattgttgggtaccctcgcatgggccccaagagggagctcaagtttgccttggagtctttctgggatgggaagagcagcgctgaggatctggagaaggttgccaccgacctcagggccagcatctggaagcagatgtcagaggctgggatcaagtacattcccagcaacaccttctcatactatgaccaggtgcttgacacaacggccatgcttggtgctgtcccggaccgctactcatggactggcggagagattggccacagcacctacttctcaatggccagaggcaatgccgctgtccctgctatggagatgaccaagtggtttgacaccaactaccacttcattgtacctgaattgagcccagcaaccaagttctcatatgcttcacacaaggctgtctctgaatacaaggaggcaaaggcgcttggtgttgacacggttccagtgcttgttggaccagtctcatacttgctgctctctaaggcggcgaagggtgtggagaaatcattctctcttctttcacttcttgatagcattcttcccatctacaaggaggttgtggctgagctgaaggcagctggtgcttcatggattcagtttgatgagcccacccttgttaaggaccttgctgctcatgaattggccgcgttctcttcagcatatgctgaacttgaatcagcactctctggattgaatgtccttattgagacatactttgccgatgttcctgctgaatcttacaagaccctcacatcattgagtggcgtgactgcctatggttttgatcttgttcgtggaactaagacagttgagcttatcaagagcacgggtatcccatctgggaagtacctatttgctggtgttgtagatggacggaacatttgggctgatgatcttgctgcatctctcagcactcttcagtctcttgagtctgttgttggcaaggacaaacttgtggtgtctacctcctgctcactgatgcacactgctgttgatcttgtgaacgagaccaagctcgacagtgagatcaagtcatggctcgcatttgctgcccaaaaggtggttgaggtgaatgcccttggcaaggctttggctggtcaaaaggatgaggcctactttgcggccaatgccgctgctcaggcctcaaggaggtcgtcacccagggtgaacaatgaggaggttcagaaggctgcggctgctttgaagggatctgaccaccgccgtgctacccctgtttctgctagactggatgctcagcagaagaagctcaaccttcctgtccttccgacaacgacaattggttcattccctcagacaatggacctcaggagggtccgccgtgagtacaaggcgaagaagatctctgaggaggactatgtcagtgctatcaaggaagaaattagcaaggttgtcaagatccaagaggagcttgacatcgatgtgctcgtccatggagagcctgagagaaatgacatggttgagtactttggcgagcaactatctggttttgcatttactgccaatggatgggtgcaatcctatggatcacgttgcgtgaagccaccgatcatctatggtgatgtcagccgccccaaccccatgactgtcttctggtccaagatggctcagagcatgacccctcgcccaatgaagggaatgttgactggcccagtcacaatcctcaactggtcttttgtcaggaacgaccagccaaggtttgagacatgctaccagattgctcttgccattaaaaaggaggttgaggatcttgaagctggtggtattcaggtgatccagatcgacgaggctgctctaagagagggtctgccactgcgcaagtcggagcatgctttctacctggactgggccgtccactcgttcagaatcaccaactgcggtgtgcaagataccactcagatccacacccacatgtgctactccaacttcaacgatatcatccactccatcatcaacatggacgccgacgtcatcaccattgagaactcacgctccgacgagaagctcctctcggtcttccgcgagggcgtgacctacggggccggcattggccccggcgtctacgacatccactcccccaggatcccctccacggaggagattgccgaccgcgtcaacaagatgctcgcggtgctcgacaccaacatcctctgggtgaaccctgactgcggcctcaagacccgcaagtacaccgaggtgaagcccgccctgactaacatggtcgctgcggccaagctcatccgcacccagctcgccagcacgaagtgaggagccatgaaatcgaacagcctgatgatactactacctattgttttgtggggacagagcgccaaacgagccgtttgtttcgaataatccgattctttatcgtaccgcccgagtctggctagggttagtcctgctgttatggtaaaactgttacatgttgatggcatacgttgtattctatgtgtttggtgggtggtct

SEQ ID NO: 3142 - DNA, 2580 bp, Hordeum vulgare subsp. vulgare
ggtgcccaccgccatcctcctctgcctcccactctatcgtcttcctcctcatctccggcgccactccgccgcccctcgactcctccaaggaccaacgaaagatggcgtcccatattgttgggtaccctcgcatgggccccaagagggagctcaagtttgccttggagtctttctgggatgggaagagcagcgctgaggatctggagaaggttgccaccgacctcagggccagcatctggaagcagatgtcagaggctgggatcaagtacattcccagcaacaccttctcatactatgaccaggtgcttgacacaacggccatgcttggtgctgtcccggaccgctactcatggactggcggagagattggccacagcacctacttctcaatggccagaggcaatgccactgtccctgctatggagatgaccaagtggtttgacaccaactaccacttcattgtacctgaattgagcccagcaaccaagttctcatatgcttcacacaaggctgtctctgaatacaaggaggcaaaggcgcttggtgttgacacggttccagtgcttgttggaccagtctcatacttgctgctctctaaggcggcgaagggtgtggagaaatcattctctcttctttcacttcttgatagcattcttcccatctacaaggaggttgtggctgagctgaaggcagctggtgcttcatggattcagtttgatgagcccacccttgttaaggaccttgctgctcatgaattggccgcgttctcttcagcatatgctgaacttgaatcagcactctctggattgaatgtccttattgagacatactttgccgatgttcctgctgaatcttacaagaccctcacatcattgagtggcgtgactgcctatggttttgatcttgttcgtggaactaagacagttgagcttatcaagagcacgggtatcccatctgggaagtacctatttgctggtgttgtagatggacggaacatttgggctgataatcttgctgcatctctcagcactcttcagtctcttgagtctgttgttggcaaggacaaacttgtggtgtctacctcctgctcactgatgcacactgctgttgatcttgtgaacgagaccaagctcgacagtgagatcaagtcatggctcgcatttgctgcccaaaaggtggttgaggtgaatgcccttggcaaggctttggctggtcaaaaggatgaggcctactttgcggccaatgccgctgctcaggcctcaaggaggtcgtcacccagggtgaacaatgaggaggttcagaaggctgcggctgctttgaagggatctgaccaccgccgtgctacccctgtttctgctagactggatgctcagcagaagaagctcaaccttcctgtccttccgacaacgacaattggttcattccctcagacaatggacctcaggagggtccgccgtgagtacaaggcgaagaagatctctgaggaggactatgtcagtgctatcaaggaagaaattagcaaggttgtcaagatccaagaggagcttgacatcgatgtgctcgtccatggagagcctgagagaaatgacatggttgagtactttggcgagcaactatctggttttgcatttactgccaatggatgggtgcaatcctatggatcacgttgcgtgaagccaccgatcatctatggtgatgtcagccgccccaaccccatgactgtcttctggtccaagatggctcagagcatgacccctcgcccaatgaagggaatgttgactggcccagtcacaatcctcaactggtcttttgtcaggaacgaccagccaaggtttgagacatgctaccagattgctcttgccattaaaaaggaggttgaggatcttgaagctggtggtattcaggtgatccagatcgacgaggctgctctaagagagggtctgccactgcgcaagtcggagcatgctttctacctggactgggccgtccactcgttcagaatcaccaactgcggtgtgcaagataccactcagatccacacccacatgtgctactccaacttcaacgatatcatccactccatcatcaacatggacgccgacgtcatcaccattgagaactcacgctccgacgagaagctcctctcggtcttccgcgagggcgtgacctacggggccggcattggccccggcgtctacgacatccactcccccaggatcccctccacggaggagattgccgaccgcgtcaacaagatgctcgcggtgctcgacaccaacatcctctgggtgaaccctgactgcggcctcaagacccgcaagtacaccgaggtgaagcccgccctgactaacatggtcgctgcggccaagctcatccgcacccagctcgccagcacgaagtgaggagccatgaaatcgaacagcctgatgatactactacctattgttttgtggggacagagcgccaaacgagccgtttgtttcgaataatccgattctttatcgtaccgcccgagtctggctagggttagtcctgctgttatggtaaaactgttacatgttgatggcatacgttgtattc

SEQ ID NO: 3143 - DNA, 3601 bp, Zea mays
ggaactgataactcgaaggggacgattgagaaatttgtccgctcaccatctcggtcggcgacagcgggaaaccactgggcctcctgcacctgcagccagcagccccgccgcgacacgctcccccgagatctccagcgcccgacttggcagatccagcaagctgcacccaccgcaggcgtgatctcctctcttggatcccgaagatggcggcgggaacggaggcctttgaggcatacttccgccgcgcggatttggaccaggacggccgcatcagcggccaggaagctgtcgccttcttccagggcgccaacctgccgcagccagtcctcgcccaggtatggatgcacgccgatcagaacaagactggtttcctcggccgcccggaattcttcaacgcgctgcgcctggtcaccgtagcgcagagcgggcgtcagctcacgcccgacatagtgcagtcggcactgtatggtcccgccgcggctcgaattccagctcccaagatagccgcgggggcggctcgttcacagatgggtgctgcgggggcgcctaggcctcaggggagcgctgcgatgacgcccgggcaggttggagcagctcagatgaatccggctggcacaccaaggccccagggaagcggtatgatgccgacatctacccaagttagtatgctgcaggtgaaccctggtgctgctccaaggccccaagggatcagttctatgatgccagctgcgagtcagggtggtgctctacaagcaactcaatttgctgcaccaagggcaatgcagccacagcctcctaacctgggaattactcaacagcaaccttctagtaccggtttcatgcggccaccacaggttggaactccagcagcttcatttcaagctcaagcgcctggaatcaatcaaggtttggtccatggaggcagcatggaaggatctatcagttggcaaggcggtaatgctgcctcagttggaggcatcccacgagctataccaggagctgctccttctcagacaacacgtggatttggtccaggtttacctagcacaatgggcatggtgcctggacaacaggtacaagcaatgtcttcatcgccattgcctccacagagcaacagtgctgttttgcctcagaattcaaaagctttggtactgtctggaaatggccctgccagcagctctggatcaagcacagacatcttctctgcacttacacagccaaagccaagcttatctgcacctcagacaagctcgattccgagttcatccagttttatggccacgcctactggctcccagaacctgactaatctcactcagtttggttctttgcaaggtagcagccaacctcaacagactcagcctatcgtaaagtccattcctgctccagctacacctgttgtctctgctgggatttctaattcagcttctcaatggcccaaaattactcaaccggacatccagaagtacatgaaagtctttggggatgttgatagggacagagatggcaaaataactggtgcagaagctcgcactctgttcctcagttggaggcttccaagggaggtcctgaagcaagtgtgggatttgtctgaccaagacaatgatggcatgctttctttgagagagttttgcatcgctctttatttaatggagaggcaccgagctggaattcctcttcccccagcccttcctgactctcttaggcatgatgagacactgttacgagctacaggcttgccttcaacagcatacaatagtccatcatggcaacacaatcaaggaggattaccacaaagaggccctggagcacctggggtgcctgctggtggtgtgcggccacccttgccatcacatttgcattcacaaactgatggagctagcagacaagggcaaccaagatctcacatgcctgggatggataatcatgtggtaattcaaggaaacaaagatgacaaaagtgcgctgaaccaggctgcacaggaggtggtggatgctcctaagaaggttgaggtggagaagcaggtcctggattccagagagaaattggagtattaccgcacaaagatgcaagatcttgtcctgtataaaagtcggtgcgagaataggctgaatgagattacagaaagggcgtcctctgataaacgcgaggtggaatcattggctaagaaatatgaagagaagtacaagcaagtagctgagttagcttccaaactagcagttgaagaagctgcatatcgtgatgttcaggagagaaaagttgagctgcatgatgcactgattaaaatggtacaaggtggaagtgttgatggtttacttcaggttcgagctgatcgaatccaatatcaattagaagagatggaaaaagctcttagtgaacggtgcaaacactttgaacttaaattcaaaccatctgcatcagttgagcttccttccggttgggaacctgggccacaagagggactcattgagtgggatgaagactgggataaatttgaagatgaagggtttagtattgttaaggataatggtacaatacaggaaaacccagtttctgctgaaaatggaaaagtgccatctctttgggatgatggtgatatgtctcctgttgcatcctctaatggtcatatcaaggaagaaaggcgttacagtggaggtgatcaagtggctgagagtgaaatagcatatgattttggtgatgaatctgtgaggagtcctggcagtgctggaagaagtgcctcagggagtccatttaaatcttccggctttggcatgcatgactcatctcccagcaaaagagaaagttacagtgaccatggtggttctgaatccgtttttggtgacaagtttgctgatgaaacttcctggaactttgatgatcaagatactgactctgtttggggttctactgtactgaacactgaggccgaccaacgcggtggcacgcataactctttctttgggtcggaggcaggctcaccaagtggcgctagtgtatttggaaagaagaggaattcattcttcgacgattctgttccaagttctcctgcatacacatctgggttctctccaaaatttggcgaaagccgtgacgatagctcctcttataacttcgggaggtttgattccttcagatcccaagacactggatccttccctcaggaaagccgtttctccaggttcgactccattagcagctccaagggcgagaatgtatcaggatttgacacagggaatagctcacgaaattttggccggtttgactcttttgatgacgccgacccattcggttcaagtggaccttttaaagcatcgggaagccggtctccacccaagttctgatatgctctctgctctgattagggttttgtgtcttgcgtcttgatttgtcaatacaaggtttagattctttgagcgaactctggcgtaacatggatttttttacctgacatttcttccattttccttatgtgcaattttcgagtccatctcacgcacaaagtggacaggtttgggtttatatctttgtttttgtaaacatttttttctgtatcttgtaaattacgccaagtctgtctttgtttatatagtttacatgtatg

SEQ ID NO: 3144 - DNA, 3407 bp, Sorghum bicolor
atggcggggacggaggccttcgaagcctacttccgccgagcggatttgaaccaggacggccgcatcagcggccaggaggccgtcgccttcttccagggcgccaacctgccgcagcaagtcctcgctcaggtatggatgcacgccgatcagaacaagactggcttcctcggccgcccggaattcttcaacgcactgcgcctggtcaccgtggcgcagagcgggcgtcagctcacgcccgacatagtgcagtcggcgctctatggtcccgctgcggctcgaattccagctcccaagatagccgcggggccggctcctgcacagatgggtgctgcgggggcgcctaggcctcaggggagtgctgcgatgacgcccacaccagggcaggttggagcggctcagatgaatccggctgccacaccaaggccccagggaagcggcatgatgccgacatctagtcaagttagcatgccacaggtgaaccctggtgctgctccaaggccccaagggatcagttctatgatgccagctgcgagtcagggtggtgctcttcaagcaagtcaatttgctggaccaagggcaatgcagccgcagcctcctaacctaggaattactcaacagcaaccttctagtaccggtttcatgcggccaccacaggttggagctccagcaacttcatttcaagctcaagcgcctggaatcaatcaaggtttggtcggtggaggcagcatgggaggatctgtcggttggcaaggcggtaatgctgcctcagtgggaggcattccgcaagctataccaggagctgctcctttacagacaacacgaggtggatttggcccaggtttacctagcacaatgggcatggcgcctggacaacaggtacaggcaatgtcttcatcgccattgcctatgcagagcaacagtgctgtgttgcctcaggattcaaaagccttggtactgtctggaaatggccctgctagcagttctggatcaagcgcagacatcttctctgcacttacacagccgaagccaagcgtatctgctcctgcacctcagacaagctcgattccgagctcatctagttttatgcccacgccaactggctcccagaacctgactaatctcgcacagtttggttcgttgcaaggtagcagccaacctcaacagactcagcctgtcgtaaagcccagtcctgctccagctgcacctgttgtctctgttgggatttctaattcagcttcccaatggccgaaaattactcaatctgacatccagaagtacatgaaagtctttggggatgttgatagggacagagatggcaaaataactggcgcagaagctcgcactctgttcctcagttggaggcttccaagagaggtcttgaagcaagtgtgggatttgtctgaccaagacaatgatggcatgctttctttgagagagttttgcattgctctttatttaatggagaggcaccgagctggaactcctcttcccccggcacttcctgactctcttaggcatgatgagacactgttacgagctacaggcttgccttcaacagcatacaatgggccatcatggcaacataatcaaggaggactaccacaaagaggccctggagcagctggggtgcctggtggtgtgcggccacccttgccaccacatttgcattcaactgatggggctagcagaccagggcaaccaagatctcacatgcctgggatggataatcatgtagtaaatcaagggaacaaagatgaaaaaagtggagtgaaccaggctgcccaggaggtggtggatgctcctaagaaggttgaggtggagaagcaagtcctggattctagagagaaactggagtattaccgcacaaagatgcaagatcttgtcctgtataaaagtcggtgtgacaataggctgaatgagattacagaaagggcgtcctctgataaacgtgaggtggaatcattggctaagaaatatgaagagaagtacaagcaagtagctgagttagcttccaaactagcagttgaagaagctgcatatcgtgatgttcaggagagaaaagttgagctgcatgatgcgttgattaaaatggtacaaggtggaagtgttgatggtttgcttcaggttcgagccgatcgaatccaatatcaattagaagagatggaaaaagctcttagtgaacggtgcaaacactttggacttcaattcaaatcatccgcatcagttgagcttccttccggttgggaacctgggccacaagagggactcattgagtgggatgaagactgggataagtttgaagatgaagggtttagtattgttaaggataatggtacaatacaggaaaacccagtttctgctgaaaatggaaaagtgccatctctttgggatgatggtgatgatatgtctcctgttgcatcctctaatggtcatatcaaggaagaaaggcgttacagtggaggtgatcaagtggctgagagtgaaatagcatatgattttggtgatgaatctgtgagaagtcctggcagtgctggaagaagtgcctcaggcagtccatttaaatcttcccgctttgggatgcatgattcatctcccagcaaaagagaaagttacagtgaccatggtggttctgaatctgtttttggtgacaagtttgctgatgaaacttcttggaactttgatgatcaagatactgactctgtttggggttctactgcactgaacactgaggctgatcaacatggtggcacacatagctctttctttgggtccgaggcaggctctccaagtggcgctagtgtatttggaaagaagaggagtacattctttgatgattctgttccaagttctcctgcatacacatctgggttctctccaaaattcggtgaaagccgtgatgatagctcctttgggaggtttgattccttcagatcccaagacactggattcttccctcaggaaagtcgtttctccaggtttgactccattagcagctccaaaggcgagaatgtatcaggattcgatacagggaatagctcacaaaattttggccggtttgactcttttgatgacgccgatccatttggttcaagtggaccttttaaagcatctggaagccggtctccacccaagttctgatatgctttttcctctgattagggttttgtgtcatgcgagttgatttgtcaatacaaggtttagattctttgagcgaactctggcgtaacatggatttttttttgcatgacatttctgccattttccttgtgtgcaattttccagtccatctcacgtacaaagtggacaggtttgggttactatatctttgtttttgtaaacatttttttttctgtatcttgtaaattaattacgccaagtctgtctttgtttatatagtttataatata

SEQ ID NO: 3145 - DNA, 3781 bp, Oryza sativa Japonica Group
gcaagttggcacgctcaccatctcgacacccggaggaggaggaccccaaccactgccctcgcagacagagaggagaagagcgcctcctgcctgccgctgcagccgcccgcgacacgctcccccctcccgagatctccgccgctcgccgccgcagatccgcgcggcgtggactccggcccagatcccggcgatggctgggatggaggccttcgaggcctacttccgccgcgcggatttgaaccaggacggccgcatcagcggccaggaggccgtcgccttcttccagggcgccaacctgccgcagcaagtcctcgcccaggtatggatgcacgccgacaagaacaagaccggcttcctcggccggccggagttcttcaacgcgctgcgcctcgtcaccgtggcgcagagcgggcgtcagctcacgcccgacatagtgcagtcggcgctgtatggccctgccgctgctagaattccagctcccaagatagccggcggcgggcaagctcccccgcagatggctgcggcgggcgctcccaggccgcaggtaaatgccgcggtgtcacctgctccagggcaggctggagctccgcagccgcagatgaatgttgctggtgctccaaggcctcagggaagtggtatgatgccgggctctgctcaaattggcggttcgcagcaggtgaacgccggagccgtgccaagaccccaaggggtcaattctatgatgccggctgcaagtcagggtggtgctctgcagccaactcagtttgcaacgcagaggggaatgcaatcacagccgcctagcatggggtttaatcaacagcctcctccttcgagtactggtttcatgaggccaactcagccaggagctccagcagcatcacttcaaggccaaggacccgggattaatcaagtaccactaggaggaggcagcatgggagcacctgctggttggcgaggaggcaatgttggttccgttggaggtctcccgcaagctactccaggagcaactgctccacaacaagcaacaccgggtggatttggtcttacattgtctagtacaatgggcatggctcccggacaacaggcacaaggaacgcctccttcgtcaatgccaccacaaagcaacagtgctgtatcagctcaagattcgaaagctttggtgctgtctggaaatggctctgccagtggcttaggagcaagcaatgacatcttctctgctcttactcagcctaagtcgaatgtatccacactttcatttccgacgagcatggctcctaattcatccagttttatgtccacaccatctggctcccagaacctgtcgaatctagctcagtttggttctcaacaaggtattccgacagtgagttctggtggcagtcaacctcaacagactcatcccatcacaaagccgagtgttccagcaccaactgtatctggtgtttctgctggagtttctaattcagcttctcaatggccaaaagttactcagtctgacatccagaagtacactaaagtctttgcggatgttgatagggacagagatggcaaaataactggcgcggaagctcgcaccctgttcctcagttggagacttccaagagagattctgaagcaagtgtgggacctgtctgaccaagataatgatggcatgctttctttgagagagttttgcattgctctttatttgatggagaggcaccgagctggaactcctttgcctccagcacttcctgactctcttaaatatgatgaggtactgctgcgtgcaacaggcttgccttcaacagcatacaacggcccgtcatggcaacaaaatcaaggactgccacacaagggtcctggagcagctgggatgcctgctactggtgtgcggcaacctttgccaccacatttgcaggcacagatggatggtgctaacagaccagggcaaccaagacctcacatgcctggtatggataaccatgcagcacctcaagcaaataaagatgacggaagtggagcgaactcagctgtgcaggaggatgcccctaagaaggttgaggtggagaagcaagtcctagattccagagagaaactagaatactaccgtacaaagatgcaagatcttgttctgtacaaaagtcggtgtgacaacaggctgaatgaaatcacagaaagggcatcctctgataaacgtgaggtggaatcattagctaagaagtatgaagagaaatacaagcaagtggcagagttagcttccaaactggcagttgaagaacatgccttccgtgatgttcaggagaggaaagttgaactgcatgatgcattagttaaaatggtacaaggtggaagtgttgatggtttgcttcaggttcgagctgatcgaatccaataccaattagaggagatggagaaagcttttagtgaacggtgcaagcactttggactgcagttcaagccatctgcatcagttgagcttccttttggttgggaacctgggaagcaagagggggcaattgagtgggatgaagactgggacaaatttgaggatgaagggtttggttttgtaaaggacaatggtacaattgttgaaaacccagttgcttctgaaaatgtgaaagtgccatctctctggaatgatatggatgagagccctgttgcatcttcgaacggtcacatcaaggctgagagacattacagagctggtgatcatgcagctgagagtgacttagggtatgattttggtgaggaatctgtaaggagccccagcagtgctggaagaagtgcatctggaagtccatttgtgtcttcaaattttgcgatgcatgactcatctcccagcaaaaaggaaacctacagtgaccatggtggttctgaatccatttttggtgacaaatatgccgatgaaacctcctggaactttgatgaccaagacactgaatctgtttggggatctaatgcaatgaacaacgagtctgaccatcatggaagtgcacacaactctttctttgggtcagatgacttcggtgtaaatcctgttagggtgggctctccaagtggtgccagtacctatggaaagaagaaaagttcattctttgatgattctgttccaagttcacctgcatacacatctggattctcaccaaaattcagtgaaagccgcgatgatagctcctcatataacttaggaaggttcgattccttcagatcccaggagagcggattcttccctcaggaaagtcgtttttccaggtttgactccataaacaactccaaaggtgagaatgtaactggattcgattcaccgaaaagctcaacaaatttcggtcggtttgattcttttgatgatgccgatccatttggttcaagtggaccctttaaagcatcaggtagcaggtctccccccaaattctgatacaccagggtactatttttagtgaattcatttgtcgatacaaggctgaattcttttgaggaaactccaacgcgttgatgcagtggaacctttttgagtgggaggttggtcattcaccttgtgcgtttttcctgtccattatacggtacaaaggggacaggttttggtatatcctttgtattttgtaaagtacaccgagtttgtttttgttcatagttatcatatctctggaacggctgctgatcatctgctgtttgccatttgtttcttggtttgtaccataccaaatgttacagttggtttactaaactcccaccattttgtaagaaactgaggacgatttagcatgtttgcgatctgtatgtgtaaaatcattttgggatc

SEQ ID NO: 3146 - DNA, 3608 bp, Hordeum vulgare subsp. vulgare
ggcgacacgctcccccgagatctccccacagcccgcggcagcagatccgcgcggccggcgagatccccgccccggatcccggccatggcggggatggaggccttcgaggcctacttccgccgcgccgacttgaaccaggacggccgcatcagcggccaggaggccgtcgccttcttccagggcgccagcctgccgcagcaggtcctcgcccaggtgtggatgcacgccgatcagagcaagaccggcttcctcggccggcccgagttcttcaacgcgctgcggctcgtcaccgtggcgcagagcgggcgccagctcacgcccgacatagtgcagtccgcgctctatggccctgccgccgccagaattccgccccccaagatagccgggcaggcgggcgtggctgctcctaggccccaaggtaatgttgctgcgccggcacccgctccggggcaggccggagctacgcagatgaatcctgctgctgccggtgctccgaggccccagggtagtggcatgatgcccacttctgctgccgctccgaggccccagggaagtggcatgatgcccacttctgctgccgccccgaggccccagggaagtggcatgatgccgacttcaactcaatttgccggtgcgccacaagcgaacgctggagctgttccgagaccccaaggcatcagctcgatgatgccggctgcaagtcagggcggcgccatgccgccaaatcagttttcggggccgaggggcactcagtcacaatctcctaacatgggttatgctcagcagctcctcacttcaagcactggtttcatgaggccaccgcctcaggtcggagctcccgcaacatcacttcaaccaactggaatgaataaaagtccactggggggaggcagcatgggaggatcagtgggttggcaaggaggtaatgttggttcatttggaggtatctcacaaccttctccaggagcagctgttccttcacagccaacgtcaggtggatttggtcttggaatgtcgagttcaatgggcatggttcctggacagcaaacacatgcattgtcctcttcatcgttgcctccacagagcaacagtgctgtattgcctgcagattcaagggctttggtgctatctggaaatggccctgccagtggctcgggagcagacactgacatcttctctgctcttactcagccgaagccgagtacatccacacctgcacttctgacaggcacaatgcccaactcatccagctttatgtccaagccgactggctcccagaacctggctaatttaacacagcctggttctctccaaagtactccaacagtgagttacggcaccagccaacctcagcagacgcagcccatcacaaagccgagtgttccagctccaggtgtttctgccggggtttctaattctacctctcaatggccaaaagttaatcaatctgatatccagaagtacacaaaagtctttggggatgtggatagggacagagatggcaaaataactggcgcagaagctcgcactctgtttctcagttggagacttccaagagatgtactgaagcaagtgtgggacttgtctgaccaagataatgacggcatgctttctctgagagagttttgcattgctctttatttaatggagaggaaccgagctggaactcctctgcctccatcgctccctgactctcttaaatttgatgagacgctgttacgagcaacaggcttgccttctacagcttacaatgccccgtcatggcagcctaatcaaggattaccgcataggggccctggcgcacctgggttgcctactggtggtgtacggccacccttgccacaaatgcattcacagactgatggagctacaagaccagggcaaccaagacctcacatgcctggtatggataatcatgcagcagctcaaggaattaaagatgacagaagtggggtaaactcagctgcacaggaggctcctaagaaggttgaggtggagaagcaggtcctagactccagagagaaactagagtactaccgcacgaaaatgcaagatcttgttctgtataaaagtcggtgtgacaatagacttaatgagatcacagaaagggcgtcttctgataaacgtgaggtggaattgttgtctaagaaatatgaagaaaaatacaagcaagtggcagagttagcttccaaactggcagttgaggaagctgctttccgtgatgttcaggagaggaaagttgagctgaatgatgcattaattaaaatggtacaaggtggaagtgttgatggtttgcttcaggttcgagctgatcgaatccaacatcaattagaggagatggagaaagcttttaacgaacggtgcaagcactttggactgcaattcaagccatctgcaacagtcgagcttccatttggttgggaacctgggcagcaagagggagcagttgagtgggatgaagactgggataaatttgaggatgaagggtttggtcttgtaaaggacaatggtacaattgtcgaaaacccagcttcttctgaaaatgcaaacacatcatctctttgggatgacggtgtctctacggatgggatgtcccctgttgcatcttctaatggtcatatcaaggatgtgagacattacagagctggtgatcaagcgcctgagagcgaattagcatatgattttggtgatgaatctgtaaggagccccggcagtgctggaagaagtgcctctgggagtccatttaagtcttctcgttttggggtgcatgactcgtctcccaccaaaaaaggaacctacagtgaccatggtggctctgagtctgtttttggagataattatggtgatgaaacgacatggaactttgatgaccaagatactgaatcagtttggggatctaatgcaatgaatgagcctggacatcatggaagcaactctttctttgggtcagatgacttcaatgtggaccctgttagagtgggctctccaagtggcgctagtgtctacggaaagaagagcacattctttgacgattccgttccaagttcccctgcatacacgtctggattctcaccgaagttcggtgaaagtcgtgacgacagctcctcctataacttcggaaggtttgattccttcagatcccaggacggcgccgtcccacaggaaagtcgcttttccaggttcgactctgtaaccagctccaaaggcgagagcgcagcaggatttgactcatcaaacagctcgagaaattttggccggttcgattcttttgatgaagctgatcctttcggttccactgggccttttaaagcatcaggagcacggtcgccccccaaattctgatattcatttgtggaattatgaggatttgtctcttgagaggaggtggaaactctactagacgactggttcatttgtcgatacagggtttgggttgctcgacggaagtacaatacaacggattcatttttttggttggcaactcacttctgttcgccctgtgtgcatttttcctgtcctccatccccacgtacaaagtggacattttttgattgtgacctgtaaagtatcctgagatttttctctgtttatagtggcttgtatctttg

SEQ ID NO: 3147 - DNA, 3813 bp, Sorghum bicolor
gagctggttgggagatctttcttgccgggctctgccgccgcggcgtcgccggcgggccgggagcggcggcgaggcgggccctgcttcgccgcggtcggaagggaggggagtgcgcacaagcggcggccgtcgctgaggtcgaccgcgccggtgggcgcgctggccgagcgcgtcgtggtgaccccggcgccgccggaggagagggccgggacggccccgccggagccgcacccgcagagcgtggccgcgcgcgccgtggtcaccgtgcggcggaggcgcaaggaggacgccaagcgccgcgtcgccgagcagctggacgcctacgccgacagggtcggccgcagcgtcctcctcgagctcatcagcacggagaccgacccaagtaagaaacatttcttccgtgatcccacctccaccacccccaccgccgccgccgccgccgcgcgacggcatggaattccatggcgcatccggcgggcggttgcgttgcatctttgaattgtatgctactagcagtagcacaatttggttccattttcttctctcctcctcgcccttttttccattccactcgccgctccttcaccttcatggaaacccgcgcgcggcgagaatattccagctggtgcgccttgacgtctggggcctctgtctccgagtcatcatctccaaatggaccatcacgtggagctgtctctcttgatttgatttctgccaaaagccgccgtctttaccgtctcctcggcgtcgaaacggaaatggaacgaattttacttacgcctggcggcgagcattcacctgacgatcgaaatgaattggtggcaggaaaagggggccccaagaagagccggcggtcggcgctggtggggtggttcgagaagaaggacgtcaaggcggagcgggtggtgtacacggcggacttcaccgtcgacgggtgcttcggcgagcctggcgccgtcaccgtgctcaaccggcaccagcgcgagttcttcatcgagagcatcgtggtggagggctttccctcgggccccgcgcacttcacctgcaactcgtgggtgcagcccacccgcgtggaccgcaacccgcgcgtgttcttcaccaacaagccctacctgccggccgagacgccgccggggctgcaggagctccgccgccaggagctcagcgacctgaggggcgagggcggcgccgacaccaccggcgagcgcaggatcaccgaccgggtgtgggagtacgacgtgtacaacgacctcggcaacccggacaagggcgccgagttcgcgcgcccgatcctcggcggcgagcagcagctgccgtacccgcgccggatgcgaacgggccggcccaagaccttcacaggtgcagcctccctctccgctttcaattcccctctcactcttcacttcttgtcaccaccgccgtccgccccataaatcccgcgacagtaactgtggccgaccggacacggcggaggtcgccgtcgcgcgtagctttcgtatcgaaaccacccgatcgcgggcgacgttgaccgaccgacgctaacatttcgtcacgcacgcacggtgcttgctgctttgcttgctcgctcgcagacgatcgcgcggagagcagggtggagtacccggagcccatctacgtgtcccgggacgaggagttcgaggagggcaagaacgagatgctgtcggagggcgcgctcaaggcgctgctccacaacttcatgccgctgctggtgagctccgtgtcgccggacatccgcgacttcgccggcttccacgacgtggacaacctcttcaaggagggcctccggctgaagcaggcactgcaggaccagctgttccagaagatccccttcgtgcgcaagatccaggagaacagcgagggcctcctccgctacgacacgcccgacatcatcaagagtaagcgacccccacccatgatccatggagattcgatacgataagatacggggcacgacaatggtgtgctcatgctgtcattctgtgtggcagaggacaagtttgcgtggctgcgcgacgacgagttcgcgaggcaggcgctggctggcatcaaccccgtcaacatcgagcggcttcaggtacacatttcaatcacaagcccaacacgccgcggacattgagactacacgtccactgctcgctcatctcactgccgttcgtttcctcgtgtctctcttcccaggcgttcccgccgatgagcaagctggacccggccgtgtacggcccgccggagtcggccatcacggaggagcacatcatcgggcagctggacggcatgtcggtgcggcaggcgctgcaggacaaccggctgtacatgctggactaccacgacatcttcctgccgttcctggaccggatcaacgcgcaggacgggcggaaggcctacggcacgcgcacgctcttcttcctgacggcggcgggcacgctcaagcccatcgccatcgagctgtgcctgccgcccatgaccgacgggtgcgcgcgcgccaagcgggtgttcacgccgcccgccgacgccaccagcaactggctgtggcagctcgccaaggcgcacgtctgctccaacgacgccggcgtccaccagctcatcaaccactggtacgacacgacactgtctgtgtcagtcttgcaggaggaggcaatctcaaagtcaaaagtgttggattccactgatcatgagttgtgccaggctgaggacgcacgcgtgcatggagccgttcatcatctcggcgcaccggcagctgagcgcgatgcaccccatcttcaagctgctcaagccgcacatgcgctacacgctcaagatcaacgcgctggcgcggcagatcctcatcaacggcgacggcgtcatcgagtccggcttcacccccggccgctactgcatggagatgagctcgttcgcgtaccaggagctctggcggctcgaccaggagggcctccctgccgatctcatcagaaggtacacagatcaatcaatcacatgaaagttgtgatgcttcgtgcgatgcaatggtgcttgctgacatgggtgttttctttgtcacaacacagaggaatggccgtggaggacccgacgcagccgcacggtctccggctgctgatcgaggactacccgtacgccaccgacgggctgctcctctgggacgccatcacgcggtggtgcgacgcgtacgtggccatgtactacccgtccgaccaagccgtgcagggcgacacggagctgcagtcgtggtacagggaggcggtgcagacggggcacgcggacaagcgcggcgcgccgtggtggccgcgcctgtcgacgccgggcgacctggcgtcgctgctcaccacgctgctgtggctcacctcggcgcagcacgcggcgctcaacttcgggcagtacccgctgggcggctacatcccgaaccgaccgccgctcatgcggcggctggtgcccgccgacggcgacccggagtacgcgcacctggtggccgacccgcaccgcttcttcctgtcggcgctgcccagcctgacgcagacgaccaccttcatgaccgtcatcgacacgctgtccacgcactccgccgacgagcagtacctcggggagcggcccgacgaggcgtggacggccgacccggcggcgctggcggcggcgcgcgagttcgcggacgaggtgcgccgcgccgaggaggagatcgaccggcgcaacgcggacacgggacgccgcaaccggtgcggcgccggcgtgctgccgtacgagctcatggcgcccacgtccgggccgggcatcacctgccgcggcatccccaacagcgtcaccatt

SEQ ID NO: 3148 - DNA, 2992 bp, Sorghum bicolor
atggcgtcggcgatggagctggttgggagatctttcttgccgggctctgccgccgcggcgtcgccggcgggccgggagcggcggcgaggcgggccctgcttcgccgcggtcggaagggaggggagtgcgcacaagcggcggccgtcgctgaggtcgaccgcgccggtgggcgcgctggccgagcgcgtcgtggtgaccccggcgccgccggaggagagggccgggacggccccgccggagccgcacccgcagagcgtggccgcgcgcgccgtggtcaccgtgcggcggaggcgcaaggaggacgccaagcgccgcgtcgccgagcagctggacgcctacgccgacagggtcggccgcagcgtcctcctcgagctcatcagcacggagaccgacccaagaaaagggggccccaagaagagccggcggtcggcgctggtggggtggttcgagaagaaggacgtcaaggcggagcgggtggtgtacacggcggacttcaccgtcgacgggtgcttcggcgagcctggcgccgtcaccgtgctcaaccggcaccagcgcgagttcttcatcgagagcatcgtggtggagggctttccctcgggccccgcgcacttcacctgcaactcgtgggtgcagcccacccgcgtggaccgcaacccgcgcgtgttcttcaccaacaagccctacctgccggccgagacgccgccggggctgcaggagctccgccgccaggagctcagcgacctgaggggcgagggcggcgccgacaccaccggcgagcgcaggatcaccgaccgggtgtgggagtacgacgtgtacaacgacctcggcaacccggacaagggcgccgagttcgcgcgcccgatcctcggcggcgagcagcagctgccgtacccgcgccggatgcgaacgggccggcccaagaccttcacagacgatcgcgcggagagcagggtggagtacccggagcccatctacgtgtcccgggacgaggagttcgaggagggcaagaacgagatgctgtcggagggcgcgctcaaggcgctgctccacaacttcatgccgctgctggtgagctccgtgtcgccggacatccgcgacttcgccggcttccacgacgtggacaacctcttcaaggagggcctccggctgaagcaggcactgcaggaccagctgttccagaagatccccttcgtgcgcaagatccaggagaacagcgagggcctcctccgctacgacacgcccgacatcatcaagaaggacaagtttgcgtggctgcgcgacgacgagttcgcgaggcaggcgctggctggcatcaaccccgtcaacatcgagcggcttcaggcgttcccgccgatgagcaagctggacccggccgtgtacggcccgccggagtcggccatcacggaggagcacatcatcgggcagctggacggcatgtcggtgcggcaggcgctgcaggacaaccggctgtacatgctggactaccacgacatcttcctgccgttcctggaccggatcaacgcgcaggacgggcggaaggcctacggcacgcgcacgctcttcttcctgacggcggcgggcacgctcaagcccatcgccatcgagctgtgcctgccgcccatgaccgacgggtgcgcgcgcgccaagcgggtgttcacgccgcccgccgacgccaccagcaactggctgtggcagctcgccaaggcgcacgtctgctccaacgacgccggcgtccaccagctcatcaaccactggctgaggacgcacgcgtgcatggagccgttcatcatctcggcgcaccggcagctgagcgcgatgcaccccatcttcaagctgctcaagccgcacatgcgctacacgctcaagatcaacgcgctggcgcggcagatcctcatcaacggcgacggcgtcatcgagtccggcttcacccccggccgctactgcatggagatgagctcgttcgcgtaccaggagctctggcggctcgaccaggagggcctccctgccgatctcatcagaagaggaatggccgtggaggacccgacgcagccgcacggtctccggctgctgatcgaggactacccgtacgccaccgacgggctgctcctctgggacgccatcacgcggtggtgcgacgcgtacgtggccatgtactacccgtccgaccaagccgtgcagggcgacacggagctgcagtcgtggtacagggaggcggtgcagacggggcacgcggacaagcgcggcgcgccgtggtggccgcgcctgtcgacgccgggcgacctggcgtcgctgctcaccacgctgctgtggctcacctcggcgcagcacgcggcgctcaacttcgggcagtacccgctgggcggctacatcccgaaccgaccgccgctcatgcggcggctggtgcccgccgacggcgacccggagtacgcgcacctggtggccgacccgcaccgcttcttcctgtcggcgctgcccagcctgacgcagacgaccaccttcatgaccgtcatcgacacgctgtccacgcactccgccgacgagcagtacctcggggagcggcccgacgaggcgtggacggccgacccggcggcgctggcggcggcgcgcgagttcgcggacgaggtgcgccgcgccgaggaggagatcgaccggcgcaacgcggacacgggacgccgcaaccggtgcggcgccggcgtgctgccgtacgagctcatggcgcccacgtccgggccgggcatcacctgccgcggcatccccaacagcgtcaccatttagtctctcgcggtaccgatagccatgggagaaatctaagcagaagcaaaatgattttttttttgctttacttctcccccattgccaaattgccattgatttggaggtctgaacaggtggagtttgatttttgactaggggagagacactgaggaactgaatgggtgtaaataatttgttattatagaaaaaaaatcaatgaaatataatcattagagtt

SEQ ID NO: 3149 - DNA, 3903 bp, Zea mays
gcgtcggcgatgaagctgctggggagatcttccttggcgagccctgctgccgcggcgcccggacgggagcggcgaggcgggccctgcttcgccgcggtcggaagggaggggagcgcgcacaggaggaggtcgtcgctgaggtcgaccgcgccggtgggcgcgctggccgagcgggtcgtggtgacgccggcgccaccggagagggccggggcgggccccccggagccgcacccccagagcgtggccgcgcgggccgtggtcaccgtgcggcggaggcggaaggaggacgccaagcgccgggtcgccgagcagctggacgcgtacgccgaccgggttggccgcagtgtcctcctcgagctcatcagcacggagaccgacccaagtaagaaacagttccgtgattccaccatccccgtcgccgcccgccacgcgatggcatggaattccaagacgcatccggcgttgcgttgcatctttgaattgtactggcagtagcatagattgattccttctttctttctttcccttttcttcactcgccgctcttcttctccgttcgctccaccgccaccaccaccacgtaccttcatggaacccgcggcgagaatattccagctggtgcgccttgacgtctggtgcctttgtctccgagtcatcatttccaaatggaccatcacgtggagctgtctctcttgatttgaatatttgatttgtgcccaaagccgccgtctttaccatctcgtctgcgtcgaaacgaagatggagttagtacgcaattacgccaggcgaggcatcgatcttaccgaatcatcgttgaatcggtggcaggaaaggggggccccaagaagagcaggcgctcggcgctggtgggctggttcgagaagaaggacgtcaagacggagcgggtggtgtacacggcggacttcaccgttgacgggtccttcggcgagccgggcgcggtcaccgtgctcaaccggcaccagcgcgagttcttcatcgagagcatcgtggtggagggctttccctccggccccgcgcacttcacctgcaactcgtgggtgcagcccacccgcgtggaccgcaacccgcgcgtgttcttcaccaacaagccgtacctgccggccgagacgccgccgggcctgcaggagctccgccgccagcagctcagcgacctgaggggcgagggtgccgacaccggcgagcgcaggatcaccgaccgggtgtgggagtatgacgtgtacaacgacctcggcaacccggacaagggcgccgagttcgcgcgcccggtcctcggcggcgagcagcagctgccgtacccgcggcggatgcgaacgggccggcccaagaccatcacaggcaagcctccgctttcccgtttccctgttcagttcttgtcaccaccgccatctgtcctataaattccgcgacagcaacagtggcgaccaagcatggcggagagggcgccgtcgccgtcgcgcgtagctttcgtatcggaaccacccgatcgcgggcgacgttgaccgaggctaacatttcctcgtggtggcgcttgcagacgaccgcgcggagagccgggtggagtacccggagcccatctacgtgtcccgggacgaggagttcgaggacgggaagaacgagatgctgtcggagggcgcgctcaaggcgctgctccataacttcatgccgctgctggtgagctccgtgtcgcctgacatccgcgacttcgccggcttccacgacgtggacaacctcttcaaggagggcctccgcctgaagcaggccctgcaggaccagctgttccagaagatccccttcgtgcgcaagatccaggagaacagcgagggcctcctccgctacgacactcccgacatcatcaagagtaagccagcgcccatgcgccttcctcctcctccgtccatgatccatggaggtccgatacgataagatacggggcacgacaatgttgtactcatgctgtcgtctgttttctttttccgcccttccgtgtggcagaggacaagtttgcttggctgcgggacgacgagttcgcgaggcaggcgctggctggcatcaaccccgtcaacatcgaacgtcttcaggtatacatatcaatcacaagcccaacacgccgcggacactgagtccgctgctcaacgaccccagccgttgctgtcaagacgccgccgtgcttaccgctcgctcactgccgtccgttcctctcgtgtctctcccaggcgttcccgccgatgagcaagctggacccggccgtgtacggcccgccggagtcggccatcacggaggagcacatcatcggacagctcgacggcatgtcggtgcagcaggcgctgcaggacgacaggctgtacatgctggactaccacgacatcttcatgccgttcctggaccggatcaacgcgctggacgggcggaaggcctacggcacgcgcacgctcttcttcctgacggccgcgggcacgctgaagcccatcgcgatcgagctgtgcctgccgccgatgaccgacgggtgcgcgcgcgccaagcgggtgttcacgccgcccgccgatgccaccagcaactggctgtggcagctcgccaaggcacacgtctgctccaatgacgccggcgtccaccagctcatcaaccactggtatgtgcacctctgaacgcggcgacacagtcggtcggtcattcccaatttccatcatcgtctgttgatgcagagcagagcaaccggagtgttggcctcgactaatcattgcgctgcgtgtgcaggctgaggacgcacgcggccatggagccgttcatcatcgcggcgcaccggcacctgagcacgatgcaccccatcttcaagctgctcaagcctcacatgcggtacacgctcaagatcaacgcgctggcgcggcagatcctcatcaacggcgacggcgtcatcgagtccgggttcacccctggccgctactgcatggagatgagctcgttcgcgtaccgggagctctggcggctagaccaggagggcctccctgccgatctcatcagaaggtacacaaatcaactggaacatctatgaagttgtagtgcttcgtgcaatgcagtgcatggaaaactggaaatacgagccgcattcaggctgacatggtgttcccttgtcacagaggaatggccgtggaggacccgacgcagccgcacggtctccggctgctcatcgaggactacccgtacgccaccgacgggttgctgctctggtcggccatcaggcggtggtgcgacgcctacgtggccatgtactacccgtccgacgagtccgtgcagggcgacaccgagctgcagtcgtggtacagggaggccgtgcacacggggcacgcggacaagcgcgacgcgccgtggtggccgcgcctgtcgacgcccgcggacctggcgtcgctgctgacgacgctgctgtggctcacctcggcgcagcacgcggcgctcaacttcgggcagtacccgctgggcggctacatcccgaaccggccgccgctgatgcggcggctggtgcccgccgagggcgacccggagtacgcgcacctggtggccgacccgcaccgcttcttcctgtcggcgctgcccagcctgacgcagaccaccacgttcatgaccgtcatcgacacgctgtccacgcactccgccgacgagcagtacctcggggagcggcctgatgaggcgtggacggccgacccggcggcgttggcggccgcgcgcgagttcgcggacgaggtgcgccgcgccgaggaggagatcgaacggcgcaacgctgacactggccgccgcaaccggtgcggcgctggcgtgctgccgtacgagctcatggcgcccacgtcggggccgggcatcacctgccgcggcgtccccaacagcgttaccatt

SEQ ID NO: 3150 - DNA, 4608 bp, Zea mays
tcgcggccctgcccaccttaaaaaaacagtcggatacgatccgcgaatgcgagctgttttgaacggcgatttgtctttttgttctccagcgcgccagccaaccttaactgctacgatcgatcgaggggaggaagtttctggagctctagttctgcccatggcgtcggcgatggagctactggggagatcgttcgcgccgggccatgccgccgcggcgccgaggcggggaggcgggccctgcttcgcggcggtcggaagggaggggagtggtgcgcacaggaggagatcgtcgtcgtcgtcgtcgctgaggtcgactgcgccggtggacgcgctggccgagcgagtcgtggcgccgccggagagggccgaggcggtcccgccggagccgagcgtggccgcgcgggccgtggtcaccgtgcggcggagtcggaaaagggacgccaagtgccgggtcgccgagcggctggacgcgtgcgccgactgggtcggccgcagcgtcctcctcgagctcatcagcaccgagaccgacccaagtaagaagaaagacttgcgtggttccgtctccaccgtccccgccgccgccgtgccgcaccgcgcgcgcgcggtggcatggaattccaatgcgcatccagcgtgcgtgcgcatcttcgaattgtattgagctagcacaatcgggttcccctccttcgtctctctttccctttctgtctcggtcgtcgtttcccattcactccttcaccttcatggaacccgcggcgagaatattccagctggtgcgccttgacgtctgggtccttgttctccgagtcgccattaatttccaaatagaccatcacgtggagctgtctgtctctctttttgtgatttgtgccaaaagctgccgccttctccgtctcggctgcatcgaaacgaaaatggagttacgcaatcatgccaggcgaggcgaggcattaatctgaccggaccatctctgaaacggtggcaggaaaaggggggccaaagaagagcaggcggtcggcgctggtgggctggtttggggagaaggacgtgaaggcggagcgggtggtgtacaccgccgacttcaacgtcgacgggtccttcggcgagccgggcgcggtcgccgtgctcaaccggcaccagcgcgagttcttcgtcgagagcatcgtggtggagggctttccctccggccccgcgcacttcacctgctactcgtgggtgcagcccacgcgcgtgcaccgcgacccgcgcgtgttcttcaccaacaagccgtacctgccggcgcagacgccgccggggctgcgggagctccgccgcctggagctcagcgacctgaggggcgagggcgctggcaccggcggcgagcgcaggaccaccgatcgggtgtgggagtacgacgtgtacaacgacctcggcaacccggacatgggcgccgagttcgcgcgcccgatcctcggcggcgaccagcagctgccgtacccgcgccggatgcggacgggccggcctaagaccttcacaggcaagcctccgcttcttccccccccccccccccccccagctcactgttcagttcttgtcaccaccgccatccgccgccccatacattccgcgacaggaacagtaccgaccgggcatggcggagggcgtagcggtcgccgtggccgtcgccgtcgcgcgtcgctttcgtatcgaacccacacgatcgcgggcgacgttgaccgacgctaacgtttcctcgtcggcgcttgcagacgaccgcgcggagagcagggtggagtacccggagcccatctacgtgtcccgggacgaggagttcgaggagggcaagaacgagatgctgtcggaaggcgcgctcaaggcgctgctccacaacttcatgccgctgctggtgagctccgtgtcgccggacttccgcgacttcgccggcttccacgacgtggacaacctcttcaaggagggcctcaggctaaagcaggccctgcaggaccagctgttccagaagatccccttcgtgcgcaaggtccaggagaacagcgagggcctcctccgctacgacacgcccgacatcatcaagagtaagcgacgcgacctcctcctccgtccacgatccatggagatccgataagatacggagcagacagtgttgtattgtactcttgctgtcgtttgattttttttttcgttcccgcccttccgtgtggcaggagacaagtttgcttggctgcgggacgacgagttcgcgaggcaggcgctggctggcattaaccccgtcaacatcgagcgccttcaggtatccatgccaatcacacgcccaacacgccgcggacactgaaaccgcacgtccacctctctccacggccccggccgttggcccgttgctgtcagcggagtggagtggaaagaccccgccgcccgcggtgcttagcgcgcgctcaccgccgttcgtttctcgtgtctcttccaggcgttcccgccgatgagcaagctggacccggccgtgtacggcccgccggagtcggccatcacggaggagcacatcatcgggaggctcgacggaatgtcggtgcagcaggcgctggaggacaaccggctgtacatgctggactaccacgacatcttcctgccgttcctggaccggatcaacgcgcaggacgggcggaaggcctacggcacgcgcacgctcttcttcctgacgggcgcgggcacgctgaagcccatcgcgatcgagctgcgcctcccgccgatgaccgacgggtgcgcgcgcgccaagcgggtgctcacgccgcccgccgacgccaccagcaactggctgtggcagctcgccaaggcgcacgtctgctccaacgacgcgggcgtccaccagctcatcaaccactggtacacacatactgcacgacgctgtctgccagtcttgcaggacgaccgaagtcgttgttggattcgactaatcattgcgctgcatgcgtgtgcaggctgaggacgcacgcgtgcatggagccgttcatcatcgctgcgcaccggcagatgagcgcgatgcaccccatcttcaagctgctgaagccgcacatgcgctacacgctcaagatcaacgcgctggcgcggcagatcctcatcaacggcgacggcgtcatcgagtccgggttcacccctggccgctactgcatggagatgagctcgttcgcgtaccgggagctctggcggctcgaccaggagggcctccccgccgatctcatcagaaggtacacaaaaacacctggaatggaaattaaaatcggaagtacgagccgcaggctgacatggtgtgtgttcccttgtcacagaggaatggccgtggaggacccgacgaagccgcacggtctgcggctgctcatcgaggactacccgtacgccaccgacgggctgctcctctggtcggccatcacgcggtggtgcggcgcctacgtggccacgtactacccgtcggacgagtcggtgcaggccgacaccgagctgcagtcgtggtacacggaggccgtgcagacggggcacgcggacaagcgcggcgcgccgtggtggccgcgcctgacgacgcccggggacctggcgtcgctgctcacgacgctgctgtggctgacctcggcgcagcacgcggcgctcaacttcgggcagtacccgctgggcggctacatcccgaaccggccgccgctgatgcggcggctggtgcccgccgagggggacccggagcacgcgcacctggtggccgacccgcaccgcttcttcctgtcggcgctgcccggcctgacgcaggccaccacgttcatgaccgtcatcgacacgctgtccacgcactccgccgacgagcagtacctcggggagcgccccgacgaggcgtggacggccgacccggccgcgctggcggccgagcgcgagttcgcggacgaggtgcgccgcgccgaggaggagatcggccggcgcaacaccgacgcgggccgccgcaaccgctgcggcgccggcgtgctgccctatgagctcatggcacccacgtccggcccgggcatcacctgccgcggcgtccccaacagtgtcaccatttagtcttctcgcttgggcggacagcggagatgatctcgaagcgaattttttccattcattgtaatcgggcggggagaaatctaaaagcagaagcaaatggttttgggaacgtatcctgtgagcacaggtcttccgtgcgcacgtgagcattttaattgggaacaattggatctataccattaaaagatccaaactttagatatataccatggacccaacatgtcattgactcatgtggacccatatgtaagtgagatagtaatagtatggatctaaagtggtgatcttttaatggtatggatccaaatttccctaattgggaagccttcatctctaatccaacattcagtgcctcttttacatctaacccctcccacctcggccacttagcccataattactttactaatcacccccctgacgtggtacagagaccaggatcgtgacggaacgaccaagtgcgcctgtacagcatctgcatctgtacaccatctcagccgccctctgtaaggcattgtacctcataatctcacacaccag

SEQ ID NO: 3151 - DNA, 3003 bp, Zea mays
cagtcggatacgatccgcgaatgcgagctgttttgaacggcgatttgtctttttgttctccagcgcgccagccaaccttaactgctacgatcgatcgaggggaggaagtttctggagctctagttctgcccatggcgtcggcgatggagctactggggagatcgttcgcgccgggccatgccgccgcggcgccgaggcggggaggcgggccctgcttcgcggcggtcggaagggaggggagtggtgcgcacaggaggagatcgtcgtcgtcgtcgtcgctgaggtcgactgcgccggtggacgcgctggccgagcgagtcgtggcgccgccggagagggccgaggcggtcccgccggagccgagcgtggccgcgcgggccgtggtcaccgtgcggcggagtcggaaaagggacgccaagtgccgggtcgccgagcggctggacgcgtgcgccgactgggtcggccgcagcgtcctcctcgagctcatcagcaccgagaccgacccaacggcgctggtgggctggtttggggagaaggacgtgaaggcggagcgggtggtgtacaccgccgacttcaacgtcgacgggtccttcggcgagccgggcgcggtcgccgtgctcaaccggcaccagcgcgagttcttcgtcgagagcatcgtggtggagggctttccctccggccccgcgcacttcacctgctactcgtgggtgcagcccacgcgcgtgcaccgcgacccgcgcgtgttcttcaccaacaagccgtacctgccggcgcagacgccgccggggctgcgggagctccgccgcctggagctcagcgacctgaggggcgagggcgctggcaccggcggcgagcgcaggaccaccgatcgggtgtgggagtacgacgtgtacaacgacctcggcaacccggacatgggcgccgagttcgcgcgcccgatcctcggcggcgaccagcagctgccgtacccgcgccggatgcggacgggccggcctaagaccttcacaggcaagcctccgcttcttccccccccccccccccccccagctcactacgaccgcgcggagagcagggtggagtacccggagcccatctacgtgtcccgggacgaggagttcgaggagggcaagaacgagatgctgtcggaaggcgcgctcaaggcgctgctccacaacttcatgccgctgctggtgagctccgtgtcgccggacttccgcgacttcgccggcttccacgacgtggacaacctcttcaaggagggcctcaggctaaagcaggccctgcaggaccagctgttccagaagatccccttcgtgcgcaaggtccaggagaacagcgagggcctcctccgctacgacacgcccgacatcatcaagagagacaagtttgcttggctgcgggacgacgagttcgcgaggcaggcgctggctggcattaaccccgtcaacatcgagcgccttcaggcgttcccgccgatgagcaagctggacccggccgtgtacggcccgccggagtcggccatcacggaggagcacatcatcgggaggctcgacggaatgtcggtgcagcaggcgctggaggacaaccggctgtacatgctggactaccacgacatcttcctgccgttcctggaccggatcaacgcgcaggacgggcggaaggcctacggcacgcgcacgctcttcttcctgacgggcgcgggcacgctgaagcccatcgcgatcgagctgcgcctcccgccgatgaccgacgggtgcgcgcgcgccaagcgggtgctcacgccgcccgccgacgccaccagcaactggctgtggcagctcgccaaggcgcacgtctgctccaacgacgcgggcgtccaccagctcatcaaccactggctgaggacgcacgcgtgcatggagccgttcatcatcgctgcgcaccggcagatgagcgcgatgcaccccatcttcaagctgctgaagccgcacatgcgctacacgctcaagatcaacgcgctggcgcggcagatcctcatcaacggcgacggcgtcatcgagtccgggttcacccctggccgctactgcatggagatgagctcgttcgcgtaccgggagctctggcggctcgaccaggagggcctccccgccgatctcatcagaagaggaatggccgtggaggacccgacgaagccgcacggtctgcggctgctcatcgaggactacccgtacgccaccgacgggctgctcctctggtcggccatcacgcggtggtgcggcgcctacgtggccacgtactacccgtcggacgagtcggtgcaggccgacaccgagctgcagtcgtggtacacggaggccgtgcagacggggcacgcggacaagcgcggcgcgccgtggtggccgcgcctgacgacgcccggggacctggcgtcgctgctcacgacgctgctgtggctgacctcggcgcagcacgcggcgctcaacttcgggcagtacccgctgggcggctacatcccgaaccggccgccgctgatgcggcggctggtgcccgccgagggggacccggagcacgcgcacctggtggccgacccgcaccgcttcttcctgtcggcgctgcccggcctgacgcaggccaccacgttcatgaccgtcatcgacacgctgtccacgcactccgccgacgagcagtacctcggggagcgccccgacgaggcgtggacggccgacccggccgcgctggcggccgagcgcgagttcgcggacgaggtgcgccgcgccgaggaggagatcggccggcgcaacaccgacgcgggccgccgcaaccgctgcggcgccggcgtgctgccctatgagctcatggcacccacgtccggcccgggcatcacctgccgcggcgtccccaacagtgtcaccatttagtcttctcgcttgggcggacagcggagatgatctcgaagcgaattttttccattcattgtaatcgggcggggagaaatctaaaagcaaaaaaaaaaaaaaaaaaaaa

SEQ ID NO: 3152 - DNA, 3110 bp, Hordeum vulgare subsp. vulgare
ggagaaaggcagcacaaaagaaaacaggggggctgctactggtgtccggtccaaccgtccaagatccagagcgagaaacatatccccctgcccggccagccgccctgacccatttcgtccccggcgagcgatcttaaccttgctaatctgcgccgacgagggaggggagcttctttctacggtcatgccgccgatggagctgctggggagatccttcttgcaggcggcaggctctgccagcaccgcggcgcctcgcggcggccgggagcgcgggctctgcttcgcgagcctgggcgggaggccctcgaggaggacggtgcggtccaaggcgccggtgggcgccctcgccgagcgggtcgtcctcacctcggcgccggccgagagggtggcccggccggaggcgcacccgcagagcgtggcggcgagggccgtggtcaccgtgcgccggaagcggaaggtggaggtcaaggagcaggtcgccgagcagatggacgcctacgccgacagggtcggccggagcgtcctgctcgagctcatcagcaccgagacggacccaagaaagggagaccccaagaagagcaacaagtcggggctggtggggtggttcgagaaacgggacgtcaaggcggaactggtggtgtacacggcggagttcaccgtcgacgccgccttcggcgagccgggcgccgtcaccgtgctcaaccggcaccagcgtgagttcttcatcgagagcatcctggtggagggcttcccgtccggcccggcgcacttcacctgcaactcgtgggtccagcccagccgcatcgaccctgccccgcgggtcttcttcaccaacaagccctacctgccgtcccagacgccgccggggctgagggacgtccggcgtcgggagctcaaggagctgcgcggcagcggcaccggcgtgcggaagaccaccgaccgggcctacgactacgacgtgtacaacgacctgggcaacccggacaagggcgccgggttcgagcgccccgtcctcggcggcgacaagctgccgtacccgcgccggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtgtcgccggacagccgcgacttcgccggcttccacgacgtcgacaacctcttcaaggagggcctccgcctcaagcaggccctgcacgaccagctgttccagaagatcccattcgtgcgcaagatccaggagaacagcgagggcctcctccgctacgacacccccgacatcatcaagaaggacaagttcgcgtggctgcgtgacgacgagttcgcgaggcaggcgctggctggcattaaccccgtcaacatcgagcggcttcaggtgttcccgccggtgagcaagctcgacccggccgtctacggcccgccggagtcggccatcacggaggagcacatcatcgggaacctggacggcatgtcggtgcagcaggcgctggaggagaacaagctgtacatgctggactaccatgacatcttcatgcctttcctcgaccggatcaactccctggacggccggaaggcctatgggacgcgcacgctcttcttcctcacggccgggggcacgctaaagccgatcgcgatcgagctgtgcctgccgcccatgaccgacgactgcaagcgcgccaagcgggtgttcacgccccccgccgacgccaccagcatctggctgtggcagctcgccaaggcccatgtctgctccaacgacgccggcgtccaccagctcatcaaccactggctgaggacgcacgcgtgcatggagcccttcatcatcgcggcgcaccggcaaatgagcgccatgcaccccatcttcaagctgctcaagccgcacatgcggtacacgctcaagatcaacgcgctggcgcggcagatcctcatcaacggagacggcgtcatcgagtccgggttcacccctggccgctactgcatggagatgagctccttcgcctacgacaacctctggcggctcgaccaggaaggcctccccgccgacctcatcagaagaggtatggctgtggaggacgcgagccagctgcacgggctccggctgctcatcgaggactacccctacgccaccgacgggctgctcctctggtcggccatcgcgcggtggtgccaggcctacgtggcggcctactacccgtccgacgaggccgtgcaggacgactacgagctgcagtcgtggtacacggaggccgtgcaggtggggcacccggacaagtgcgacgcgccgtggtggccgcgcctcaccacggccggcgacctcgcgtccctgctcaccacgctggtgtggctgtgctcggcgcagcacgccgcgctcaacttcggccagtacccgctcggcggctacatccccaaccggccgccgctcatgcgccggctggtgccggccgagggcgacccggagtacgagcacctcgtcgccgacccgcaccggttctacctgtcggcgctgcccagcctcacgcagacgacgaccttcatgacggtcatcgacacgctctccacgcactccgccgacgagcagtacctcggggagcggcccaacgaggagtggacggcggacccggcggcgctggctgctgcgcaagagttcgcggcggaagtgcgccgcgccgaggaggagatcgagcggcgcaacgctgaccccgcccggcgcaaccgctgtggcgccggcgtgctgccgtacgagctcatggcgccgtcgtccgggccgggcatcacctgccgaggcgtcccgaacagcgtcaccatctagcccgcagagagtgaattgaagcggaccgtgggaatttttcagcctcgatatactttgggccgggaacgtctcagggaaaagtacgtacatataagagaatcgccattgatttgggccctcgccacgaaggccgaatcgccattgatttgggcccagataggagaagatttaattgcatttttttctgttc

SEQ ID NO: 3153 - DNA, 3123 bp, Hordeum vulgare subsp. vulgare
aaaacaggggggctgctactggtgtccggtccaaccgtccaagatccagagcgagaaacatatccccctgcccggccagccgctctgacccatttcgtccccggcgagcgatcttaaccttgctaatctgcgccgacgagggaggggagcttctttctacggtcatgccgccgatggagctgctggggagatccttcttgcaggcggcaggctctgccagcaccgcggcgcatcgcggcggccgggagcgcgggctctgcttcgcgagcctgggcgggaggccctcgaggaggacggtgcggtccaaggcgccggtgggcgccctcgccgagcgggtcgtcctcacctcggcgccggccgagagggtggcccggccggaggcgcacccgcagagcgtggcggcgagggccgtggtcaccgtgcgccggaagcggaaggtggaggtcaaggagcaggtcgccgagcagatggacgcctactccgacagggtcggccggagcgtcctgctcgagctcatcagcaccgagacggacccaagaaagggagaccccaagaagagcaacaagtcggggctggtggggtggttcgagaaacgggacgtcaaggcggaactggtggtgtacacggcggagttcaccgtcgacgccgccttcggcgagccgggcgccgtcaccgtgctcaaccggcaccagcgtgagttcttcatcgagagcatcctggtggagggcttcccgtccggcccggcgcacttcacctgcaactcgtgggtccagcccagccgcatcgaccctgccccgcgggtcttcttcaccaacaagccctacctgccgtcccagacgccgccggggctgagggacgtccggcgtcgggagctcaaggagctgcgcggcagcggcaccggcgtgcggaagaccaccgaccgggcctacgactacgacgtgtacaacgacctgggcaacccggacaagggcgccgggttcgagcgccccgtcctcggcggcgacaagctgccgtacccgcgccggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtgtcgccggacagccgcgacttcgccggcttccacgacgtcgacaacctcttcaaggagggcctccgcctcaagcaggccctgcacgaccagctgttccagaagatcccattcgtgcgcaagatccaggagaacagcgagggcctcctccgctacgacacccccgacatcatcaagaaggacaagttcgcgtggctgcgtgacgacgagttcgcgaggcaggcgctggctggcattaaccccgtcaacatcgagcggcttcaggtgttcccgccggtgagcaagctcgacccggccgtctacggcccgccggagtcggccatcacggaggagcacatcatcgggaacctggacggcatgtcggtgcagcaggcgctggaggagaacaagctgtacatgctggactaccatgacatcttcatgcctttcctcgaccggatcaactccctggacggccggaaggcctatgggacgcgcacgctcttcttcctcacggccgggggcacgctgaagccgatcgcgatcgagctgtgcctgccgcccatgaccgacgactgcaagcgcgccaagcgggtgttcacgccccccgccgacgccaccagcatctggctgtggcagctcgccaaggcccatgtctgctccaacgacgccggcgtccaccagctcatcaaccactggctgaggacgcacgcgtgcatggagcccttcatcatcgcggcgcaccggcaaatgagcgccatgcaccccatcttcaagctgctcaagccgcacatgcggtacacgctcaagatcaacgcgctggcgcggcagatcctcatcaacggagacggcgtcatcgagtccgggttcacccctggccgctactgcatggagatgagctccttcgcctacgacaacctctggcggctcgaccaggaaggcctccccgccgacctcatcagaagaggtatggccgtggaggacgcgagccagccgcacgggctccggctgctcatcgaggactacccctacgccaccgacgggctgctcctctggtcggccatcgcgcggtggtgccaggcctacgtggcggcctactacccgtccgacgaggccgtgcaggacgactacgagctgcagtcgtggtacacggaggccgtgcaggtggggcacccggacaagtgcgacgcgccgtggtggccgcgcctcaccacggccggcgacctcgcgtccctgctcaccacgctggtgtggctgtgctcggcgcagcacgccgcgctcaacttcggccagtacccgctcggcggctacatccccaaccggccgccgctcatgcgccggctggtgccggccgagggcgacccggagtacgagcacctcgtcgccgacccgcaccggttctacttgtcggcgctgcccagcctcacgcagacgacgaccttcatgacggtcatcgacacgctctccacgcactccgccgacgagcagtacctcggggagcggtccaacgaggagtggacggcggacccggcggcgctggctgctgcgcaagagttcgcggcggaagtgcgccgcgccgaggaggagatcgagcggcgcaacgctgaccccgcccggcgcaaccgctgtggcgccggcgtgctgccgtacgagctcatggcgccgtcgtccgggccgggcatcacctgccgaggcgtcccgaacagcgtcaccatctagcccgcagagagtgaattgaagcggaccgtgggaatttttcagcctcgatatactttgggccgggaacgtctcagggaaaagtacgtacatataagagaatcgccattgatttgggccctcgccacgaaggccgaatcgccattgatttgggcccagataggagaagatttaattgcatttttttctgttcaaaagttgggacatgctaaaaaaaaaaaaaaaa

SEQ ID NO: 3154 - DNA, 3442 bp, Hordeum vulgare subsp. vulgare
gagcaccggcacctcacctgcgtcgaagcctcggccccgcagctcgctcgcccgccgttttctattcgcgtaggatgtatggaacacgtgtggccggcgcggggattccacatcgcgctcgtggtttctttccctcgggcgaccgcgcgctccgctcgggcgctcggcctccctctgcctctgggttagctacccttcgccctcctcccgccagcgcctatatataatgcgctcccagtcccactacgagagagaaaggcagcacaaaagaaaacagaggggctgctactggtgtccggtccaaccgtccaagatccagagcgagaaacatatccccctgcccggccagccgccctgacccatttcgtccccggcgagcgatcttaaccttgctaatctgcgccgacgagggaggggagcttctttctacggtcatgccgccgatggagctgctggggagatccttcttgcaggcggcaggctctgccagcaccgcggcgcctcgcggcggccgggagcgcgggctctgcttcgcgagcctgggcgggaggccctcgaggaggacggtgcggtccaaggcgccggtgggcgccctcgccgagcgggtcgtcctcacctcggcgccggccgagagggtggcccggccggaggcgcacccgcagagcgtggcggcgagggccgtggtcaccgtgcgccggaagcggaaggtggaggtcaaggagcaggtcgccgagcagatggacgcctacgccgacagggtcggccggagcgtcctgctcgagctcatcagcaccgagacggacccaagaaagggagaccccaagaagagcaacaagtcggggctggtggggtggttcgagaaacgggacgtcaaggcggaactggtggtgtacacggcggagttcaccgtcgacgccgccttcggcgagccgggcgccgtcaccgtgctcaaccggcaccagcgtgagttcttcatcgagagcatcctggtggagggcttcccgtccggcccggcgcacttcacctgcaactcgtgggtccagcccagccgcatcgaccctgccccgcgggtcttcttcaccaacaagccctacctgccgtcccagacgccgccggggctgagggacgtccggcgtcgggagctcaaggagctgcgcggcagcggcaccggcgtgcggaagaccaccgaccgggcctacgactacgacgtgtacaacgacctgggcaacccggacaagggcgccgggttcgagcgccccgtcctcggcggcgacaagctgccgtacccgcgccggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtgtcgccggacagccgcgacttcgccggcttccacgacgtcgacaacctcttcaaggagggcctccgcctcaagcaggccctgcacgaccagctgttccagaagatcccattcgtgcgcaagatccaggagaacagcgagggcctcctccgctacgacacccccgacatcatcaagaaggacaagttcgcgtggctgcgtgacgacgagttcgcgaggcaggcgctggctggcattaaccccgtcaacatcgagcggcttcaggtgttcccgccggtgagcaagctcgacccggccgtctacggcccgccggagtcggccatcacggaggagcacatcatcgggaacctggacggcatgtcggtgcagcaggcgctggaggagaacaagctgtacatgctggactaccatgacatcttcatgcctttcctcgaccggatcaactccctggacggccggaaggcctatgggacgcgcacgctcttcttcctcacggccgggggcacgctaaagccgatcgcgatcgagctgtgcctgccgcccatgaccgacgactgcaagcgcgccaagcgggtgttcacgccccccgccgacgccaccagcatctggctgtggcagctcgccaaggcccatgtctgctccaacgacgccggcgtccaccagctcatcaaccactggctgaggacgcacgcgtgcatggagcccttcatcatcgcggcgcaccggcaaatgagcgccatgcaccccatcttcaagctgctcaagccgcacatgcggtacacgctcaagatcaacgcgctggcgcggcagatcctcatcaacggagacggcgtcatcgagtccgggttcacccctggccgctactgcatggagatgagctccttcgcctacgacaacctctggcggctcgaccaggaaggcctccccgccgacctcatcagaagaggtacggctgtggaggacgcgagccagctgcacgggctccggctgctcatcgaggactacccctacgccaccgacgggctgctcctctggtcggccatcgcgcggtggtgccaggcctacgtggcggcctactacccgtccgacgaggccgtgcaggacgactacgagctgcagtcgtggtacacggaggccgtgcaggtggggcacccggacaagtgcgacgcgccgtggtggccgcgcctcaccacggccggcgacctcgcgtccctgctcaccacgctggtgtggctgtgctcggcgcagcacgccgcgctcaacttcggccagtacccgctcggcggctacatccccaaccggccgccgctcatgcgccggctggtgccggccgagggcgacccggagtacgagcacctcgtcgccgacccgcaccggttctacctgtcggcgctgcccagcctcacgcagacgacgaccttcatgacggtcatcgacacgctctccacgcactccgccgacgagcagtacctcggggagcggcccaacgaggagtggacggcggacccggcggcgctggctgctgcgcaagagttcgcggcggaagtgcgccgcgccgaggaggagatcgagcggcgcaacgctgaccccgcccggcgcaaccgctgtggcgccggcgtgctgccgtacgagctcatggcgccgtcgtccgggccgggcatcacctgccgaggcgtcccgaacagcgtcaccatctagcccgcagagagtgaattgaagcggaccgtgggaatttttcagcctcgatatactttgggccgggaacgtctcagggaaaagtacgtacatataagagaatcgccattgatttgggccctcgccacgaaggccgaatcgccattgatttgggcccagataggagaagatttaattgcatttttttctgttcaaaagttgggacatgctaatatggtggaatgtgtaaatgatctcgtaagttcctatagttaagagattccgacagatgcttg

SEQ ID NO: 3155 - DNA, 1468 bp, Zea mays
gcgtcctggtccagcgcttcctctccagctccagcgccgcagcgcgctcgcccgtgcctcatctccagctctccagcgccgcagcgcgctcacggcccaccagcgccagccgccaggccgccaccgcggcaccgccaggcgcccaggcgcgctcgcccgccgaccgccgttgtccttgtccagccgccggagtccggagcaccgagcacgggagcagccgaggcgagcaaccgagcaccgccattgagcaacagtgaccgtgagccaagccgggaactctgggggtcagtagcccgatggctttcgctgagagattgatccgcaaacgattaagaagagtactgttattctgaacaaaaagaactctctcaatatcaccacaggaacaaaggatcagaaatggctatgcaggccgcaaggaggctagcatctttgaaactccaacgacgcctactccttccctctcaggccgagtccccaagcataagcatcccaaccgcagcggcggcggcagccttcctccactcccatgccaccagcttcgggtacaagcaggttcgcgaagaggataagagcaaattggttggcaacgtgttcagcagcgtggcttctagctacgacctcatgaacgatctcatgagtgtcggcctgcataggctgtggaaggacaggcttatttccaagctgaaccccttttcggggatgaagcatctcgatgtggctggtggaacaggtgatgttgcttttcgtgtactggaaagagttaagagtgtgggtcacagagctatgcagggtactcttactgaaaccgaagaaggcacccacatttatgtctgtgacattaatccaaatatgctaaatgttgggaaaaagcgtgctgcagaaagaggttatagcgaagaacattgtcttagctggatacaaggagatgcagaagctctgagttttgaggatggatctatggatggttacactatcgcatttgggatcagaaatgtgacgcacattgagaaagctctgtcagaagcttacagggttctaaagcaaggggggaggttcctatgcttggagttgagtcatgtggatgtccctatttttaaagagatttatgatgtttactcgttttctatggttccggctattggagagctggttgctggtgatcggcagtcgtaccaatacttggttgagagcatccgtcggtttccgaatcaggaaaagtttgctcagatgattcaggaagccggattccagagggtggaatatgagaacctcgtgggtggtgtagttgccattcattctggactgaaactgtagagctgaatacggatggatattttttcatacgtgcaccgcttctacaattagtagtatttgtttttaaattaattctataataggttcggtggcttgtaaaagcagctggtgctggctgtcagcatcagcacaataagtagtatttgctaat

SEQ ID NO: 3156 - DNA, 1407 bp, Zea mays
agctccagcgccgcagcgcgctcgcccgtgcctcatctccagctctccagcgccgcagcgcgctcggccgctcgcccgcggcccgcgcggccgcgcctcctctccagcgccgcagcgcgctcacagcccaccagcgccagccgccaggccgccaccgcggcaccgccaggcgcccaggcgcgctcgcccgccgaccgccgttgtccttgtccagccgccggagtccggagcaccgagcacgggagcagccgaggcgagcaaccgagcaccgccatcgagcaacagtgaccgtgagccaagcaggggaacaaaggatcagaaatggctatgcaggccgcaaggaggctagcgtctttgaaactccaacgacgcctactccttccctctcaggccgagtccccaagcataagcatcccaaccgcagcggcggcggcagccttcctccactcccatgccaccagcttcgggtacaagcaggttcgcgaagaggataagagcaaattggttggcaacgtgttcagcagcgtggcttctagctacgacctcatgaacgatctcatgagtgtcggcctgcataggctgtggaaggacaggcttatttccaagctgaacccctttccggggatgaagcatctcgatgtggctggtggaacaggtgatgttgcttttcgtgtactggaaatagttaagagtgtgggtcacagagctatgcagggtactcttactgaaaccgaagaaggcacccacatttatgtctgtgacattaatccaaatatgctaaatgttgggaaaaagcgtgctgcagaaagaggttatagcgaagaacattgtcttagctggatacaaggagatgcagaagctctgagttttgaggatggatctatggatggttacactatcgcatttgggatcagaaatgtgacgcacattgagaaagctctgtcagaagcttacagggttctaaagcaaggggggaggttcctatgcttggagttgagtcatgtggatgtccctatttttaaagagatttatgatgtttactccttttctatggttccggctattggagagctggttgctggtgatcggcagtcgtaccaatacttggttgagagcatccgtcggtttccgaatcaggaaaagtttgctcagatgattcaggaagccggattccagaaggtggaatatgagaacctcgtgggtggtgtagttgccattcattctggactgaaactgtagagctgaatacggatggatgttttttcatgcgtgcaccgcttctacaattagtagtatttgttttttttcaaattaattctataataggttcggtggcttgtaaaagcagctggtgctggctgtcagcatcagcacaataagtagtatttgctaaaaaaaaaaaaaaaa

SEQ ID NO: 3157 - DNA, 1411 bp, Zea mays
gctccctcgcctctcctgctcggtgctcgccagtcgcccccgctccctgggcacccgcttcccttggctcacccgacgccgccggcccacggttggcctggccccctcccccctcgcctgctctgctgcggcgctgctcgcccgtcgccccgcttccctggctcactccctcttttcggtctctgtcacccttctcacggaggaacaaaggatcagaaatggctatgcaggccacaaggaggctagcgtctttgagcctccaacgacgcctactccttccctctcagaccgaggccccaagcatcccaaccgcggcggcggcggccttcctccactcccatgccaccagcttcgggtacaggcagattcgcgaagaggataagagcaaattggttggcaacgtgttcagcagtgtggcttccagctacgacctcatgaacgatctcatgagtgtcggcctgcataggctgtgtaaggacaggcttatttccaagctgaacccctttccggcaatgaagcatctcgatgtggctggtggaacaggtgatgttgcttttcgtgtactggaaagaattaagagtgtgagtcacagagctatgcagggtacacttactgaaaccgaagaagacacccacatttatgtctgtgacattaatccaaatatgctaaatgttgggaaaaagcgtgctgcagaaagaggttatagcgaagagcattgtcttagctggatacaaggagatgcagaagctctgagttttgaggatggatctatggatggttacactattgcatttgggatcagaaatgtgacgcacattgagaaagctctatcagaagcttacagggttctaaagcgaggggggaggttcctatgcttggagttgagtcatgtggatgtccctgtttttaaagagatttatgatgtttactcgttttctgtgattccgactattggagagctggttgctggtgatcggcagtcgtaccaatacttggttgagagcatccgtcggtttccaaatcaggaaaagtttgctcagatgattcaggaagccggattccagagggtggaatatgagaacctcgtgggtggtgtagttgccattcattctggactgaaactgtagagctgaatacggatggatgttttttttatcattcatgcgtgcaccgcaccttctaaaaacaataaattctacaataagcagtactcctgcaatatattttgttaatgttgtttttagaaggagctggtgcacgcttaaaagagttatatggttgtttcagtgattttccttttcccttgagacctatttgctgcaacaagaaataagaatgaccaaactcttgtattgacagtgaggttttaactgtgttagctgttaccggcttgccaaaaaaaaaaaaaaaa

SEQ ID NO: 3158 - DNA, 1355 bp, Oryza sativa Japonica Group
atctggcccaataatagcccacacaaccctaggctgcgctagtgtcgtcggtccccatcccattcggccaccgatcccaatctcaatctgacgccgccgccggcatccctgactcaccgacgcggctgcaccaggcgccgccgccgccgcctccgccttgatcgtaaggaagtaagtttggagcaccatggctctgcgatcggcggccggtaggctggcgtcgtccagccgccgccgcctcctctctccgcccaccagcatccacacggccttcctccactcccacgccaccagcttcggatacaagcaagtagctgaagaggacaaaagcaaattggtcggtaacgtcttcagcagcgtcgcctccagttacgatctcatgaacgatcttatgagcgttggactacataggttgtggaaggacaggctcatctcaaagcttaatccttttcctgggatgaagcatctagatgtggctggtggaacaggggatgttgccttccgtgcgctcgagagaatcaatagcgtgagccatagagctatgcagggtactcttactgatattgaagaagaaacacaaatctatgtttgtgacattaatccaaatatgctgaatgttggaaagaaacgtgcttcagaaagaggatacaaagaaggccattgccttagctggatacaaggagatgctgaagctctgagttttgaggatggatctatggatggctatactattgcgtttgggatcagaaatgtgacacacattgaaaaagctctatcagaagcttatagagtcctaaagcgagggggaaggttcctatgcttggaattgagtcatgtggatgttccgctttttaaagagatttatgatgtttattcattttctgtgattccggctgtgggagaactagtggccggtgatcgccagtcataccaatacttggttgagagtatccgccggtttccaaatcaggaaaagtttgctcagatgatccaagaagccggatttgagagggtagaatacgaaaatctggtgggtggtgtggttgccattcactctggactgaaactgtagaacattctgggtttcaagtttgatggatactttactgttactcctacggcaacggcaaggtcttgtgaagcgggcgttaagaatcaggacctaacgaacaaactaactcaatcttgtaccagtagttagcattgcaataaatacatgcagtgtttctgtacatgtttcttgtatttattttttttagatgaaaggcttttgacagcccagctttactgaaaagcataaaatgttgttttgacaaccaaaacaaacaactaaaagggagtcacactagattgac

SEQ ID NO: 3159 - DNA, 1205 bp, Hordeum vulgare subsp. vulgare
ggtcgtctcgcatctccgcacgcaccgccgtcgccgcccgtgctcccttctcccccctcccccccgtcgacggccatctattactccgggctcggatcggctatctcgccccgccaaggaaggaagggcatggctctgcgagcagccgccgcgcggctggcgtcctccagcctccgccgccaccacggccacctcctcccggcggcctccgccgccagccacgcggccttcctccactcccacgccaccagcttcggattcaagcaggtgcgcgaggacgagaagagcaagctggtcggcaacgtattcagcagcgtcgcctccagctacgacgtcatgaacgacctcatgagcgctgggctgcacaggctctggaaggacaggctgatttcaaagctgaatccttttcctggtatgaagcacctggacgtggccggtgggacaggggatgttgcattccgtgtagtggaaagaattaagagtgtgagccacagagctatgcagggtactcttactgatatggaagaagacactcacatttatgtttgcgacattaatccaaatatgctagaagttggaaagaagcgtgctgctgaaaaaggctacaatgaagagaagtgccttagttgggtacagggagatgcagaagctctttcttttgaggatgggtctatggatggctatactattgcattcgggatcagaaatgttacgcacattgagaaagctctatcagaagcttacagagttctaaagaaaggaggaaggttcctgtgcttggagttgagccatgtggatgttccagtttttaaagacatttacgacatctattcgttttctgtgattccggctgtgggagagctagttgctggtgataggcagtcgtaccaatacttggtcgagagcattcgtcggtttccaaaacaggaaaagtttgctcagatgatccaggaagctgggtttgaggcagtcgaatatgaaaatctggtaggtggtgtagttgccattcactctggagtgaaactgtaatataggttgaatagcagcagaggcgacgctttcgtgggtggtggtggatctgaatcaggcatttggggctaacaatcgaccattttctttgttaaaaattaatgtaactattcccgtttatgtaattcaaaataagaaccgatgatgatatgcacagaggtcttatttttttcaag

SEQ ID NO: 3160 - DNA, 1416 bp, Sorghum bicolor
aattgaaaaaaaaaatccatctcgagcccaaccgtcctcgtttccgtttccttctccctgctcgcgttcctcccttccgttcgccgccgccgccgctgccgctgcatccgtcaccttcacacagcgtgcgctcgctccctctctttccctccctcctttcctctctgtctgcgacgactgggtgggctaccgccgccgccaccctgcgccaggtgccgaggctttcgcctatctcttcgccggcgaagagcgcccaccaggtcctattactagatccgcccctgatgcaggccgcaaggaggctagcgtgttggagcctccaacgacgcctactccttccctctcaggctcaggccccaagcatcccaacggcggcagccttcctccactcccacgccaccagcttcggtacacattgctcgtatccattgtttccgcttatatagatagatcctgaaatctcgtagttcatcagggtacaaacaggtgcgcgaagaggaaaagagcaaattggttggcaacgttttcagcagcgtggcttccagctacgacctcatgaacgatttcatgagcgtgggactgcatcggctgtggaaggacaggcttgtttccaagctgaatccctttccggggatgaagcatctcgatgtggctggtggaacaggcgatgttgcttttcgtgtactggaaagaattaagagcgtgggtcacagagctatgcagggtactcttactgaaaacgaagaagacacccacatttatgtctgtgacattaatccaaatatgctaaatgttgggaagaagcgtgctgcagaaagagggtatagcgaagaacattgtcttagctggatacaaggagatgcagaagctctgagttttgaggatggatctatggatggttacactattgcatttgggatcagaaatgtgacgcacattgagaaagctctatcagaagcttacagggttctaaagcgagggggcaggttcctatgcttggagttgagtcatgtggatgtccctgtttttaaagagatctatgatgtttactcattttctgtgattccgactattggagagctggttgctggtgatcggcagtcgtatcagtacttggttgagagcatccgtcgatttccaaatcaggaaaagtttgctcagatgattcaggaagccggattccagagggtggaatatgagaacctcgtaggtggtgtagttgccattcattctgggctgaaactgtaagctgaatcatgtgacgtgtgcaacgtgcatttgatctctcagaaaataaggaaagatagctagatgcagcctactttgttctcctgtggtggtcttcctcaaaaactttgtatgtacggatcttattgttcatatggagagaccgaaataaaattcctttttccctgc

SEQ ID NO: 3161 - DNA, 1213 bp, Populus trichocarpa
aaacactttcttcaagacgaaacgaaacaccaccgcgttcacagttttaacattgagcccaaaaaaaaccgaagagatcatcagcaaagaaatagaagaagaagtttgtaaactagttggtgcagaaatcaccgttgaattaagacatggcgctgaaattggttagcaggaagctggggagcaaattcttgcccatgctgtcttccacttctccactgcattcacatgccactagctttggattcaaacatgttcgagaagaagaaaaaagtcaaatggttggtaatgttttcagcagtgtggcctcaaattatgatctcatgaatgatttaatgagtggtggattacataggttatggaaggacagactggtttctatgctgaatccatttcctggaatgaagcatcttgatgtggctggtggaacaggagatgttgctttcaagattctggatggcataagtagtatcaagcgtagagcaaatcaagatcccattaatgatcatttacaggaagaaacacagatacatgtgtgtgacataaacccaaacatgttaaatgttggcaaaaaacgggctatagagaggggtcttggagaagacaaatcactcatatgggtggagggagatgctgaagccttaagttttgaagataataccatggatggctacacaatagcatttggaattaggaatgttacacacatagagaaagttcttgctgaagcgtatagggtattaaaacacggaggaagatttctttgccttgaactgagccacgttgaagttcctgtgtttaaagaattatatgattactattcattctcagtcattccagctgtgggagagctagttgcaggtgatcgggattcttatcagtacttggttgagagcatacgtcgttttcctccacaggtgaaatttgcttcgatgattgcagatgcaggatttcagaaggttgagtatgagaatctcgttgggggagttgtagccattcattcaggtttaaaaatatgaaggtgttcaaggacaaaccttaatttgtctcaattttttcttaaataatgcatctgcaagttttttgaggatgcagaaattttgtcagcacacctattatcctctttcttttctatttagacgttcaattcagagggctaatgcattttttgtatggttttggtattgaataaatgactcttcagcctactctttgg

SEQ ID NO: 3162 - DNA, 1992 bp, Sorghum bicolor
atggcgagcacacggaggttgagccgtgtcctcctcaccgagctgggtagtatcgccatgctcacgctactgctggtgttgctgctgccggcgagccatgcgcgcgtgtgcccgccgtgcggcacgacggccgtgccgtacccgctgagcacgggcgacggctgcggcgacccggcgtacaaggtccggtgcgccgccaactcgtcgctcgtgttcgacgcgctgaacggcacgtcttacccgatcacgtccatcacgcccgcggcgcagcggctggtggtctcgccggcgcctttcgtgtcgcagccgcagggcagcagctgcgtgtcggagggcgcgccggcggggcgcggggtgcagctgaacgcgtcgctgccgttcaacgtgagctcgtccaacaccatcatgctgctcaactgcaccaaggacctgctgctgtcgccgctcaactgctcgtccaactcgctctgccacgtctacgccaacgccacggggtccacggcgtcggcgtgcgcgccgttgccgctctgctgcaccttcgtcgccgggggatcctccacgtcctacagcatccgggtctccccgcggttctgcagcgcgtaccgcagcttcgtggggctcgacccgacgacgcagccgccagacacgtggggcagccgcctcgggctggagctgcagtgggccacgcccagggagccgctctgccgcacgcaggctgactgcgaggacggcgccaacgccacctgcgccgacgacccgctcaacacgccgtccggcgccagcgcgggctcggtccgccgctgtttctgcgtgtccgggctcacctggagccctctcgccggcgcgtgccagctgaatccctcggattgtcagatcgctgggaactgcggaggatccaaccatgcgcctctcattgcagggctggtgtgtggcctcggcagcacgttgctggttgccacggcggcgttgttcgtctatcgccggcagcagcgcatccggctcgcccgagagaggttggccaaggagcgcgaggagatcctgaacgccaacaacacgagcgggcgcaccgccaagaacttctccggtcgcgagctgaagcgcgccacgggcaacttctcccgcgacaacctccttggcgtcggtggctacggcgaggtctacaagggcgtgctcggcgacggcacggtcgtggccgtcaagtgcgccaagctcggcaacaccaaatccacggaccaggtcctgaacgaggtgcgcgtgctgtcgcaggtgaaccaccgcagcctggtgcgcctgctcggctgctgcgtcgacctggagcagccgctgatggtgtacgagttcatccccaacggcaccctcgccgaccacctgtacggctccatgaaccgcccgccgctccggtggcaccagcgcctggccatcgcgcgccagacggcggagggcatcgcgtacctgcacttcgcggcctcgccgcccatctaccaccgcgacatcaagtcgagcaacatcctcctggacgaccggctcgacggcaaggtctctgacttcgggctgtcccggctggcggagccagggctgagccacgtctccacctgcgcgcaggggacgctggggtacctggacccggagtactaccgcaactaccagctcacggacaagagcgacgtctacagcttcggcgtcgtgctgctcgagctgctcacgtccaagcgcgccattgacttcggccgtggcgccgacgatgtcaaccttgccgtgcacgtgcagcgggtggcggacgaggagaggctcatggacgtcgtggacccggcgatcaaggagggcgccacgcagctcgagctcgacaccatgaaggcgctcgggtttctagcgttgggatgcctcgaggagcgccggcagaaccggccatccatgaaggaagtcgcggaggagatcgagtacatcatcaacatcgaggctgctggccatcccatcgagcagcagctagcgtag

SEQ ID NO: 3163 - DNA, 2218 bp, Zea mays
gcaggcagataaaaagtcaaacctcctccttaatagaagaaataattcatacatattacatacgacaagcgcgaggagacaaggtaagcatttgggtcctccactccgtctccgagatgggtatcgctctcctcgcgctgctgctggtgctgccggcgagccatgcgcgggtgtgcccgccgtgcgggtcgacggccgtgccgtacccgctcagcacaggcgacggctgcggcgacccggcgtacaaggtccggtgcgccgccgccaccaactcgtcgacgtcgtcgccgacgctcatgttcgatgcgctgaacggcacgtcgtaccggatcacgtccatctcggccgcgacgcagcggctggtggtcgcgccggcgccgttggtggcgcagggcagcaggtgcgtgtcggaggggcgcggcggcggggtgcagctgaacgcgtcgctgccgttcaacgtgagctcgtccaacaccatcatgctgctcaactgcaccagcgcgctgctgctgtcgccgctcaactgctcctccaactcgctctgccacgtctacgccaacgccacggggtccacggcggcggcttgcgcgccgctgccgctctgctgcaccttcgtggcggggggctcgtccacgtcctacagcatccgggtgtccccgcagttctgcagcgcgtaccgcagcttcgtggggctcgacccggcggcgcagccgccggccacgtggggccgccgcctcgggctggagctgcagtgggccacgcccagggagccgctctgccgcacgcaggccgactgcgaggacggcgccaacgccacctgcgccgacgacccgctcacgcccgcggcccgccgctgcttctgcgtgcccgggctctcgtggagccccctcgccggcgcgtgccagctgaatccctctgattgccagatcgctgggggctgcggaggatccaaccatgcgcctctcattgcagggctggtgtgcggcctcggcggcgcgttgctgctcgccgcagcggggctgctggcgtaccggcggcagcggcgcgtccggctcgcccgggagaggctggccaaggagcgggaggagatcctgaacgccaacaacgcgagcgggcgcaccgccaggaacttctccggccgcgagctgaagcgcgccacgggcaacttctcccgcgacaacctcctgggcgccggcggctacggcgaggtctacaggggcgtgctcggcgacggcacggtggtggccgtcaagtgcgccaagctgggcaacaccaagtccacggaccaggtcctgaacgaggtgcgcgtgctgtcgcaggtgaaccaccgcagcctggtccgcctgctcggctgctgcgtcgacctggaccagccgctcatggtgtacgagttcgtccccaacggcactctcgccgaccaccttcacggcgccacgagcctgagccgcccgcccacgctcgggtggcgccagcgcctggccatcgcgcgccagacggcggagggcgtcgcgtacctccactccgcggccgtgccgcccatctaccaccgcgacatcaagtccagcaacatcctgctggacgcccgcctggacgccaaggtctccgacttcgggctgtcccggctggcggagcccgggctgagccacgtgtccacctgcgcccagggcaccctgggttacctggacccggagtactaccgcaactaccagctcacggacaagagcgacgtctacagcttcggcgtcgtgctgctcgagctgctcacgtccaagcgcgccatcgacttcgcccgcggcgccgacgacgtcaacctcgccgtgcacgtgcagcgggcggcggacgaggagaggctcatggacgtcgtcgacccggccatcaaggacggcgccacgcagctccagctcgacaccatgaaggcgctcgggttcctagcgctcgggtgcctcgaggagcgccggcagaaccggccgtccatgaaggaggttgcagaggagatcgagtacatcatcaacatcgaggccgccggccatcctatcgagcagcagcgaacttgcctagactccagcgagtgatatgaacttgtctagaacgtatgaatatcttcggaaatcaagatactcctattttgtaatactcttctgataccagagttgttgaaatagtcaataattactatatacgcaacagatgtgtcatcatgatatgatttacgcttgag

SEQ ID NO: 3164 - DNA, 2178 bp, Hordeum vulgare subsp. vulgare
ggacggcaaagaaacttgaagcaatggcgagaccgttttgcggccgtctcatgttcttctccgaggttacagccgtcgccatcctcgcggcggcggcgctgctgccggtgggctgccatgcgcgggtctgccccccgtgcggctcgacggcggtgccgtacccgctgagcacggcggccgggtgcggcgacccggcgtacaaggtccggtgcgcggccggcacgtcggcgctcttcttcgacgcgctcaacggcacctcgtacccgatcacctccgtctcgccggcggagcagcgcctggtggtctccccggcgccgctggtgtccaacgacacgtgcgtgtccgtgggggccgccgccggccgcggcgtgcagctggacccgtcgctgcccttcaacgtgagctcctccaacaccatcatgctcctcaactgcacgtccgcgctgctgcgctccccgctcaactgctcgtccagctcgctctgccacgcctacgccgacgccacggcgtcgccctgcgcgccgctgccgctctgctgcacgttcgtggcgggcgggtcgtcgacgtcgcaccggatccgtgcctcgcccgagctctgcagcgcctacaccagcttcgtggggctcgaccccgcgcagccgccggcgacgtggggcggccggctcggcttggagctgcagtgggcgacgccgagggagccggcctgccagacgcaggcggactgcgaggacggcgccaacgccacgtgcgccggtgacccggtcgcggccggcgcggtgcggcgctgcctctgcgtccccgggctcgcgtgggaccccgtcgccggcgcgtgccagcagattccttctgattgcgagcgcagtggagactgcgagggatccaaccgcgcgcctatcatcgcagggatagtgtgcggcctgggcggcgccctgctactgatagccgcagggctattcctctatcggcggcagcggcgcatccggttagcccgggagaggttgatcaaggagcgcgaggacatcctgaatgcgaacaactccagcggccgcaccgccaagaacttcaccgcccgcgagctcaagcgcgccacggccaacttctcccgcgacaacctcctcggcgtcggcggctacggcgaggtctacaagggcgcgctcgccgacggcaccctggtcgccgtcaagtgcgccaagctcggcaacaccaagtccacggaccagatcctcaacgaggtgcgcgtgctgtcgcaggtcaaccaccgcagcctcgtccgcctcctcggctgctgcgtcgacctccagcagccgctcatggtgtacgagttcatccccaacggcacgctctcggaccacctctatggcgctatgagccagccgccgctcccgtggcgccggcgcctggccatcgctcgccagacggccgagggcatctcctacctgcacttctccgcctcgccgcccatctaccaccgggacatcaagtccagcaacattctcctcgacgagcagctggacggcaaggtctccgacttcgggctgtcccggctggcggagccagggctgagccacgtctccacctgcgcgcaagggacgctgggctatctcgacccggagtactacaggaactaccagctcacggacaagagcgacgtgtacagcttcggggtggtgctgctggaactgctcacggcgaagcgcgccatcgatttcggtcgcggcgaggacgatgtcaacctcgccgtgcacgtgcagcgggcggcggacgaggagcggctcctggacgtggtggacccggccatgaagaaccgcgccacacagttggagctcgacactatgaaggcgcttgggttcttagcgctcggttgcctcgaggatcgccggcacaaccgtccgtccatgaaggaagtcgccgacgagatcgagtatatcatcaacattgaggctggggccgctgccgtcgagcaggagcagcaaaacccatgattgatgaccgtgaaatccgtgatacataccctagatctaagccctgtactactatatatgcatctttggcatgttatcgatgttgtacgctagggtaatagtgttgaggtcaatgacgcctaattaggagcaccacaattactcccatcgtcatctatatactactccccgttcttaaatataagtctttttagat

SEQ ID NO: 3165 - DNA, 2186 bp, Hordeum vulgare subsp. vulgare
ggacgacggcaaagaaacttgaagcaatggcgagaccgttttgcggccgtctcatgttcttctccgaggttacagccgtcgccatcctcgcggcggcggcgctgctgccggtgggctgccatgcgcgggtctgccccccgtgcggctcgacggcggtgccgtacccgctgagcacggcggccgggtgcggcgacccggcgtacaaggtccggtgcgcggccggcacgtcggcgctcttcttcgacgcgctcaacggcacctcgtacccgatcacctccgtctcgccggcggagcagcgcctggtggtctccccggcgccgctggtgtccaacgacacgtgcgtgtccgtgggggccgccgccggccgcggcgtgcagctggacccgtcgctgcccttcaacgtgagctcctccaacaccatcatgctcctcaactgcacgtccgcgctgctgcgctccccgctcaactgctcgtccagctcgctctgccacgcctacgccgacgccacggcgtcgccctgcgcgccgctgccgctctgctgcacgttcgtggcgggcgggtcgtcgacgtcgcaccggatccgtgcctcgcccgagctctgcagcgcctacaccagcttcgtggggctcgaccccgcgcagccgccggcgacgtggggcggccggctcggcttggagctgcagtgggcgacgccgagggagccggcctgccagacgcaggcggactgcgaggacggcgccaacgccacgtgcgccggtgacccggtcgcggccggcgcggtgcggcgctgcctctgcgtccccgggctcgcgtgggaccccgtcgccggcgcgtgccagcagattccttctgattgcgagcgcagtggagactgcgagggatccaaccgcgcgcctatcatcgcagggatagtgtgcggcctgggcggcgccctgctactgatagccgcagggctattcctctatcggcggcagcggcgcatccggttagcccgggagaggttgatcaaggagcgcgaggacatcctgaatgcgaacaactccagcggccgcaccgccaagaacttcaccgcccgcgagctcaagcgcgccacggccaacttctcccgcgacaacctcctcggcgtcggcggctacggcgaggtctacaagggcgcgctcgccgacggcaccctggtcgccgtcaagtgcgccaagctcggcaacaccaagtccacggaccagatcctcaacgaggtgcgcgtgctgtcgcaggtcaaccaccgcagcctcgtccgcctcctcggctgctgcgtcgacctccagcagccgctcatggtgtacgagttcatccccaacggcacgctctcggaccacctctatggcgctatgagccagccgccgctcccgtggcgccggcgcctggccatcgctcgccagacgtccgagggcatctcctacctgcacttctccgcctcgccgcccatctaccaccgggacatcaagtccagcaacattctcctcgacgagcagctggacggcaaggtctccgacttcgggctgtcccggctggcggagccagggttgagccacgtctccacctgcgcgcaagggacgctgggctatctcgacccggagtactacaggaactaccagctcacggacaagagcgacgtgtacagcttcggggtggtgctgctggaactgctcacggcgaagcgcgccatcgatttcggtcgcggcgaggacgatgtcaacctcgccgtgcacgtgcagcgggcggcggacgaggagcggctcctggacgtggtggacccggccatgaagaaccgcgccacacagttggagctcgacactatgaaggcgcttgggttcttagcgctcggttgcctcgaggatcgccggcacaaccgtccgtccatgaaggaagtcgccgacgagatcgagtatatcatcaacattgaggctggggccgctgccgtcgagcaggagcagcaaaacccatgattgatgaccgtgaaatccgtgatacataccctagatctaagccctgtactactatatatgcatctttggcatgttatcgatgttgtacgctagggtaatagtgttgaggtcaatgacgcctaattaggagcaccacaattactcccatcgtcatctatatactactccccgttcttaaatataagtctttttagatatttc

SEQ ID NO: 3166 - DNA, 2115 bp, Hordeum vulgare subsp. vulgare
gacggcaaagaaacttgaagcaatggcgagaccgttttgcggccgtctcatgttcttctccgaggttacagccgtcgccatcctcgcggcggcggcgctgctgccggtgggctgccatgcgcgggtctgccccccgtgcggctcgacggcggtgccgtacccgctgagcacggcggccgggtgcggcgacccggcgtacaaggtccggtgcgcggccggcacgtcggcgctcttcttcgacgcgctcaacggcacctcgtacccgatcacctccgtctcgccggcggagcagcgcctggtggtctccccggcgccgctggtgtccaacgacacgtgcgtgtccgtgggggccgccgccggccgcggcgtgcagctggacccgtcgctgcccttcaacgtgagctcctccaacaccatcatgctcctcaactgcacgtccgcgctgctgcgctccccgctcaactgctcgtccagctcgctctgccacgcctacgccgacgccacggcgtcgccctgcgcgccgctgccgctctgctgcacgttcgtggcgggcgggtcgtcgacgtcgcaccggatccgtgcctcgcccgagctctgcagcgcctacaccagcttcgtggggctcgaccccgcgcagccgccggcgacgtggggcggccggctcggcttggagctgcagtgggcgacgccgagggagccggcctgccagacgcaggcggactgcgaggacagcgccaacgccacgtgcgccggtgacccggtcgcggccggcgcggtgcggcgctgcctctgcgtccccgggctcgcgtgggaccccgtcgccggcgcgtgccagcagattccttctgattgcgagcgcagtggagactgcgagggatccaaccgcgcgcctatcatcgcagggatagtgtgcggcctgggcggcgccctgctactgatagccgcagggctattcctctatcggcggcagcggcgcatccggttagcccgggagaggttgatcaaggagcgcgaggacatcctgaatgcgaacaactccagcggccgcaccgccaagaacttcaccgcccgcgagctcaagcgcgccacggccaacttctcccgcgacaacctcctcggcgtcggcggctacggcgaggtctacaagggcgcgctcgccgacggcaccctggtcgccgtcaagtgcgccaagctcggcaacaccaagtccacggaccagatcctcaacgaggtgcgcgtgctgtcgcaggtcaaccaccgcagcctcgtccgcctcctcggctgctgcgtcgacctccagcagccgctcatggtgtacgagttcatccccaacggcacgctctcggaccacctctatggcgctatgagccagccgccgctcccgtggcgccggcgcctggccatcgctcgccagacggccgagggcatctcctacctgcacttctccgcctcgccgcccatctaccaccgggacatcaagtccagcaacattctcctcgacgagcagctggacggcaaggtctccgacttcgggctgtcccggctggcggagccagggctgagccacgtctccacctgcgcgcaagggacgctgggctatctcgacccggagtactacaggaactaccagctcacggacaagagcgacgtgtacagcttcggggtggtgctgctggaactgctcacggcgaagcgcgccatcgatttcggtcgcggcgaggacgatgtcaacctcgccgtgcacgtgcagcgggcggcggacgaggagcggctcctggacgtggtggacccggccatgaagaaccgcgccacacagttggagctcgacactatgaaggcgcttgggttcttagcgctcggttgcctcgaggatcgccggcacaaccgtccgtccatgaaggaagtcgccgacgagatcgagtatatcatcaacattgaggctggggccgctgccgtcgagcaggagcagcaaaacccatgattgatgaccgtgaaatccgtgatacataccctagatttaagccctgtactactatatatgcatctttggcatgttatcgatgttgtacgctagggtaatagtgttgaggtcaatgacgcctaattaggagcacc

SEQ ID NO: 3167 - DNA, 1529 bp, Zea mays
atcagcagaccaccacccaatcacaccagctctctctagagctagccctctcttcctccaacacttgttgatcccctcccatctcctcaagccttcttcactgaatttctggccggtcgatcgtcatgcacagctacagagccatgcacccgtacactcatcactcgtaccagcaccacaccgcggccgttgcgcccaccaagcacggccacggccacggacatggacatggccatggcgacgaggaggacgaccagtccatgctgctcctctccctctggcctcctggccaccaccacggcaacgccgctgcttcatcggcgtgctcgtctcccccgatctgcgccagcgccaccaccacctctatggcagccgctgcctcctcccccgcttcttacccttggctcacccaccaaagcctttacaataatgccggctgcggcggagggagcagcagcagcagccacagtagcttcctgttccaggagcatcagcaggagccaggtgtcagcatctcactgtccatagccccgccgtgcagcaacaacgcggcttcgtcctgtggtggcggtggcttcgctgcaccgccggcggcaccgtcgacggtgacgacgaccgtgacgccgggcgggggccaggttcccagacagtactggatcccctccgccgccgagatcctggtcggctccacgcagttctcctgcgccgtctgcaacaagaccttcaaccgcttcaacaacatgcagatgcacatgtggggccacggttcgcagtaccgcaaggggtcggagtccctgcgcggcgccatcacggtgggcacggctccgccggcgtcgctgatgcggctgccgtgctactgctgcgcggaaggctgccggaacaacatcgagcacccgcgggcgcggccgctcaaggatttccgcacgctgcagacgcactaccggcgcaagcacggcgcgcggccgtacgcgtgccggcgctgcggcaagcggttcgccgtgcgtggggactggcgcacgcacgagaagaactgcggcaagctctggttctgcgtctgcggctccgacttcaagcacaaacggtcgctcaaggaccacgtccgctccttcggcggcggccacgcgccgcacctcgtcgagtccgtcgctgtcgaggacgaggaggaggaggacgacgaccacgacgacgacgacctgcagacttttgacgacaacggcggcgccggcgcagaccccagcgacatggtcgtcatctaggtctaggcttcctcattcgaccgatctagtactactactactactccatcgattgacatgaatagttctcgatccgccacttattaagttattagctagcttgctcatccctaaattagctgccgacttttttagctagctatagatttcagtagcttatatactarcttgttggttctgattagagctgcaataaaaaaaaaaaaaaaaaaaaaaaaaaaaaaarrarwaawwaaaaaaaaaaaaaaaaaaaaawtaaaaaaaaaaaaaaaa

SEQ ID NO: 3168 - DNA, 1113 bp, Sorghum bicolor
atgcacagctacagagccatgcacccgtacactcacccgtaccagcaccacaccgccgccgttgcgcccaccaagcacggccacggccatggcgaggaggaggacgatcagtccatgctgctcctctccctctggcctcccggccaacaccatggcatcgccgctgcttcctcggcgtgctcgtctcccccaatctgcgccaccaccaccaccaccacctccatggccgccgccgcttcttacccttggctcactacccaccaaagccattacaatggcggctgcggcggagggagcagcagcagcagccacagtagcttcctgttccacgagcaccagcagcaggagcccgacgtgagcatctcactgtccatagccccgccgtgcagcaacaccgctgcttcctgtggtgccgccgccggtggcttcgctgccccggccgcaccgtcgacggtgacgaccgtgacgcccggcgggagccaggtgcccagccagtactggatcccctccgccgccgagatcctggtcggctccacgcagttctcctgcgccgtctgcaacaagaccttcaaccgcttcaacaacatgcagatgcacatgtggggccacggttcgcagtaccggaaggggtccgagtccctgcgcggcgccatcacggtgggcacggcgccgccggcgtcgctgatgcggctgccgtgctactgctgcgcggagggctgccggaacaacatcgagcacccgcgggcgcggccgctcaaggacttccgcacgctgcagacgcactaccgccgcaagcacggcgcgcggccgtacgcgtgccgccgctgcggcaagcgcttcgccgtgcgcggcgactggcgcacgcacgagaagaactgcggcaagctctggttctgcgtctgcggctccgacttcaagcacaagcggtcgctcaaggaccacgtccgctccttcggcggagggcacgcgccgcacatcgtcgagtccgtcgccgtcgaggacgacgaggaggacgacgacgaccacgacgacgcagacctgcacgcttttgacgacaacgtcggaaacggcggcggtgccggaggagaacccagcgacatggtcgtcgtctag

SEQ ID NO: 3169 - DNA, 1444 bp, Zea mays
ctctctccccaccatcagcagaccaccaccaatcacacacaccggccggccagctctctagctcttcctccaacacttgttgctccgctcccatcccctcaagcckctcttcactgaattttctggtcgccatgcacagctactacagagccatgcacccgtacgctcacccgtaccagcaccatgccgccgccgttgcccccaccaccaagcacggacactgccatgatgccgaggaggaggacgaccatcagtccatgctgctcctctccctgtggcctcccggccaccaccaccacagcgtcgccgccgccgcttcctcggcgtgctcgtctcctcccaccatatgcgccaccaccagcaccacctccatggccgcctccgccgcttcttcttacccttgttgcctcacccaccaaagccattacaatggcggcggatctgcagggagcagcagccacagtagctgcttcttgttccaccacgagcaccagcagcagcaggagcccgatgtgagcatatcgctgtccatagccccgccgcgcagcaacaacgacgcagcttcctgtggtggccgtggcttcgctgccccgtcgacggtgacgacgccggaggtgcccaccagccagtactggatcccctccgcctccgagatcctggtcggctccacgcagttctcctgcgccgtctgcaacaagaccttcaaccgcttcaacaacatgcagatgcacatgtggggccacggttcgcagtaccgcaagggctccgagtccctgctacgcggcgccattatcacggtgggcacggcggcggcggcgtcgtcgtcgctgacgcgcctgccgtgctactgctgcgcggaggggtgccggaacaacatcgagcacccgcgggcgcggccgctcaaggacttccgcacgctgcagacgcactaccggcgcaagcacggcgcccggccctacgcgtgccgccgctgcggcaagcgcttcgccgtgcgcggcgactggcgcacgcacgagaagaactgcggcaggctctggttctgcgcctgcggctccgacttcaagcacaagcggtcgctcaaggaccacgtccgatccttcggcggcggccacgcgccgcgcgtcgtcgagtccgtcgccgtcgaggacgaggaggaggaggaggacgtcgacgacgctgatgacgatggcgacctgcagactttcgacgacaacggcgccagcggagaacgacccagcgacatggtcgtcgtctagaggcttgcttcttcattaattagatcgatgtggtactatagtatgctagctactctactccaccgatggacataagtagttctaatgtgctgctcatgcatctcttagccgatcgcgcggtcttattagctatatatatatatatatatagatttcatttcagtagttatataaaaaaaaaaaaaaaa

SEQ ID NO: 3170 - DNA, 1642 bp, Hordeum vulgare subsp. vulgare
gacagaccagcaatcagatcaaagagagctagctagcctcaggcgcagctagtcatagctttctttctaggcagcacactgcacagcacacctctcttcctctccaacacttgttgctcccctcgcttccaatccagcctactctcaaacttccacacgcgccgggagagaaagagcgagagccatgcacagctacagagccatgcacccccacccccacccgtaccacaccgcgcctgcccctccgaccaagatggccagtggtggccatggcggcgccaccgaggatgacgaccagtccatgctcctcctctccctctggccgcccggccaccaccatgacgccgcggcctcctcctcggcgtgctcctcacactccgtcgccacggccgcgcactccaccgcgtcttcgccttggttcaacccaagccatgtctacaatggctgcggcgtcggaggcggtggcgggagcggcagcggtggcttcttgttccacgagcagggccgtaacgtgagcgtatcactctccatcgcccctccgtctccctgcggtgccaatctggcccccagcggcgggagcttcgccgcgccgctcgcgccgccatcggccgcctccgcgggcgggaaccaggtgcccagccagtactggatcccttccgccgccgagatcctcgtcggctccacccagttctcctgcgcagtctgcaacaagaccttcaaccgcttcaacaacatgcagatgcatatgtgggggcacggctcgcagtaccgcaaggggtcggagtcgctacggggggccgtgacggtgggcacggcggcgccgccgccgtcgctgctgcggctgccgtgctactgctgcgcggaggggtgccggaacaacatcgaccacccgcgggcgcggccgctcaaggacttccgcacgctgcagacgcactaccgccgcaagcacggcgcgcggccctacgcgtgccgccggtgcggcaagcggttcgccgtgcgcggcgactggcgcacccacgagaagaactgcggcaagctgtggttctgcgtctgcggctccgacttcaagcacaagcgctccctcaaggaccacgtgcgctccttcggaggcggccacgcgccgcacatcgtcgagtccgtggccgtcgacgaggacgaagacgaggacgacgagcacgatgacggcgaccagctgcatctgtacgacgagaacggcaacgccggcgacggcagcgacatggtcttgctctagacaactactcctccctccctagctttgttgcccgtacgatgtcttagttagtactggtccactaactagtacgtactcctagtacctagtagcttctaggtttagttctcattgcttcccaagtgcatcgttattagtacgttcagagtgtgcttgcatggcgaggtgttacagccctagtgcaagcttaattacaagtgtgcgtgcgtctgtggcgactctagctagctaggtctgtgtgtctgtcccatggaagaagtgtcgtagtacggtcagagtcatgcgatcaaccgagacgagatgtgtggtgtactgtgtcatggtcacttcatgtatttgtcgtttggtctttatctgcgtctaaagttctaccactgttttatggtgtcc

SEQ ID NO: 3171 - DNA, 1389 bp, Zea mays
gctccctagagcctcctcgccgcgtgcccagccgtcgagttcccctgcgcgcggagcttttccctccctgctcgctcctccactgcgcgtgccgctcctttttccccgcgcgtgcaacctcctctgctggtcgtccctggtgctccctgctcgtgccgtgtccctgtttttctttccctctctgctcgtcctccacttagctcatggcgcatgtccctgctcggatctctgccttccgccatggccacgtccaccacttttagctgccgctgtttttcctctggtgctcgcccctgcgttggtcatgcgcctggttgccgagtccctgcttcctgcgccctggcgcccaaccccacgcggcctccctgctcggaccgcgttcttggctccagctcggctctgtcttgtgccggcgtcctctactccatctttttccctagcgcgccctggtattcgctcgctgctgcgcgcgctctcccctgtctgctcgtcgtggacgcgggccgctgcccatgccgagctcccttcagttctccagcgtcgcgagctctccgtggtcgacgctcccagccctctactcaccgagctccgtgcaggtgcgccccatcccgcctgcactcggaccgcgccctcgctgctggtgctcgccgaccgcggttgtcctgcaccctgttgcgctcgtccaggtcgccgctgtcgagtccctgtgtgcgcagccatgtccctctgctcgccgtgctagccgtctacgtcatcgccggacttgtctccccgaccatcgtgatgttgttatttcctgctgcgccgtgacatcgtcaagctccagtgcttagcgtcgaggtcgctgcgctgttgtcgctctaacttccttgttcttgcgcggcgtgtggcggtcgtgttcacatcagcggcatcgatcagcgtccccatccccatcgccgttgaactcccagacatgttcctctctgtttgcttgtcctcggttccggcgcgcgtgattttaaagctctacgcgttcgtcgtgccgcgctatcatcacctcctatcgtaaactcgatccccgttgtcgttgcttcaccgtactcgttggtcgtacgcccttggagctccctgttgagtaaaataaatgaaccggagatcatcgtggtctctcatctaccaagccgattcggttatggtaagccgatttatttttacggttaattagattgtttagttatattgtggcgatgctctggaaagaatacatttctcatttcttttgtgtgttatatgttgccataaggtattgtagaaatatttcccatgcagtagtcatgtcatgtgctattagacttgtatgcaaggcacgattaaattaataatgtaagaagtgggattaacattttt

SEQ ID NO: 3172 - DNA, 1444 bp, Zea mays; identical to SEQ ID NO: 3169

SEQ ID NO: 3173 - DNA, 1113 bp, Sorghum bicolor; identical to SEQ ID NO: 3168

SEQ ID NO: 3174 - DNA, 1529 bp, Zea mays; identical to SEQ ID NO: 3167

SEQ ID NO: 3175 - DNA, 1631 bp, Zea mays
cgcgtgcacaggaccacgccctccctgctccatcttcccatcgctcgctcctcaagttcctagcgcccagctgaattcccctgcgcgcgccctatcttccaccatgtgccctgctcgcccatggcgccagccacagctcggagctccctctgcatccccaggcctgcgcctgctgcttgccccagcttggagctcgctcgacctccagctccggcgcccggctgagctccctggctgccgcgccctgctctcttttgctgctcaccggtgctccagctcgcggcgcccctgcttttctctctcctcctctactcccgccatggcgcgcgtctctgctccctcccccacggcgtgcccctcaagctcgtccaggccgcgacctcgtcgtggaccttcctcgccggcgctcctccctgctcagctctccagcgcgcgccccatctcgctgcgctcggcccccagctcggtcttcctcggtcgcgctcgctctggtcgtggacaccgtcgagctcagggccctgctcgccgtatgtccacgcatcatgcgtggagcaatgggggaaatctatagcctaacagcttgttcgctgcggcttgctgcggctgcaatccggctgcggctgcggcttctacagtatttttctctctatggattgcagctgcagcagtccaaacagctgcaacagtgtcggcttgcagcctgccgaacacgccctaagccttggtcaatgtctgtgtggatttgggaaagaagacggagatatggttgtagaagacagtgaagtcggcttgtgtcgcacgtctggtgctcgacgaaaagctcaaacatgagaccgtcatcgattcggttgtcgtccatctcaccaacatattttatccgtcgtggtttagctcgccatgggcctgctcattgtccctattttgccttccccaagaagccacgtggatggccttgccctcgccatcatcgttcggtcacctcgccttaatgccagcccctatatgatgcctccgacttgtgttcacgccgacaaaagaatcccaagaggatgtggagaagcaagcccctggtcgatgcccccaagtgctcagcgaaaggcctgaacaaggatcatcgtcatttttgcgaagttctagtactatggagagattccaagaattgtggattgaggagaaagtgaagctcagttcaatactcgtctggtgtttgatcgaagacttcaatcggagactgtcgtcgttctcgcaaatattgagtcaagttaattatggtgagccgattcagtatttttactattgattttatgatcgggaaataagacgcttagtttgcgtatgaagtttaagttagaaataccagtgatgcgaggtgtgcttcgatgagtttagttgccgagtatattcgaactagttctattttgcagagtgtagtgtctcggtgacgcgtaggttaagtttagtattttaagcaattatcgataagtctgtcgatgctaattgtgttcagtgcgcgtatgatgaaatcgatgtcctgtgctagtagttagtatcatctatgtttgtgatcgataatgttggagtcggatattgattagttagattgatagctatgaataaatagttgttatctg

SEQ ID NO: 3176 - DNA, 1400 bp, Sorghum bicolor
tgccatcgatcgagcgatcggcttctcggctcctgcttccagtgcccgacgaggccgacgatggcgcagcgcaaagttgccatggcggccgcagcgttcttcgcccttctcgccgtggcttcgctcctgtgcgcgccggccgccgcggggctggtccgcatggagcacccggccaagaacgacggctccctcagcctgctcgtcgtcggcgactggggccgcaagggcacgtacaaccagtccagggtcgcctatcagatgggcaaggttggggagcagctcaacatcgactttgtcatttccaccggggacaacttctacgagaacggcctgacgggcacggatgatcaagggttcgagcagtccttcaccgatatctacacggcgaagagcctgcagaagccgtggtacctggtactgggaaaccatgactacaggggtgatgcgctcgcacagctgagcccagtcctgcgaaagattgacagccgattcatttgcatgaaatcatttatcgttaatgcagaaattgtggacttcttctttgttgacaccactccgtttcaactcaagtactggactcaccctaaagatgatcactatgactggagaggagtggcacctcgagaaaaatacataaatattttgctcaaggatttggatgaggccatgaagaaatcaactgcggcgtggaagattgccgtgggccaccataccatgaggagtgtcagtgatcatggtgacactaaggagctactgcaactactgcttccagtccttcaggccaacggcgtcgatttctacatcaacgggcatgaccactgcctggaacacatcagcagcagagacagcccaatccaatacttcacaagcggaggcggttcgaaagcatggagaggagtgcaaaataccaacgaagatgacctcaagttcttctatgatggacaagggttcatgtccctccagctagaccatagcgaagcccatttcaccttttacgatgtcgatggagaggcactgtaccattacacgcggccgagcctgaggaaaactgcaggccacctccaagcctccggctatgtcaacgaggaatgaagcaggagcgagaataatcagctagcagcagctggagaatagtgatcgattctgatcagtgtgaaattcgaatgtgactgatgagcgggcatacgtggtctacagaggaagtgtattattagtagcatttatttaagtatgagatgtggttcatctgtcactgccgttggaaactatttggcccatgccaccggttccaaaacatgccctgcaagtttgcacggcggccccatcgctccagtatctagttgctcggtcatattgttcgcggccctcgccatcactccatttgatcatgtaagatcttt

SEQ ID NO: 3177 - DNA, 1569 bp, Zea mays
tgtcgatcctaatagtcgtcgatcgttccatcgaccggccggccggccagcctagctcttggctcttgctccgatcggatcgagcgccggacaaggcaaggcagccgtacacgtacgacgatggcgcagggcagccgcagcgctaccgtgcccgccgcagcgtccttcttcgcccttgtcgccgtggccccgctgctcctgtgctgcgcgccggccgccgcggagctggcccggctggagcacccggccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtaggggcagccatgatgtagcaaaaaaaaaaatagtgcaaatattcattatcgaggagttaaaacattaattgtgtggacagcggccgagcataggaccaaaatcagcagggggcaatcaacagattatgtaaaaattacatggttcagtggtgcgacaataaagacacagtatatatatggaaatatatcgtatgc

SEQ ID NO: 3178 - DNA, 1564 bp, Zea mays
gtggcgcttgtctcgatcgttccatcgaccggcggccggccagcctagctcttggctcttgctccgatcggatcgagcgccggacaagtcaaggcagccgtacgtacgacgatggcgcagggcagccgcagcgctgccgtgcccgccgcagcgtccttcttcgcccttctcgccgtggcggccccgctgctcctgtgctgcgcgccggccgccgcggagctggccaggctggagcacccgcccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtaggggcagccatgatgtagcaaaaaaaaaaatagtgcawatattcattatcgaggagttaawacattaattgtgtggacagcggccgagcataggaccaaaatcagcagggggcaatcaacagattatgtaaaaattacatggttcagtggtgcgacaataaagacacagtatatatatggaaaaaaaaaaaaaaaa

SEQ ID NO: 3179 - DNA, 1398 bp, Oryza sativa Japonica Group
ggagcctctcgttaccgagagagagagagagagagagagagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattcatacaacttcttgccagaggaccatcgattatgccatgtataatttacaaagaaggcttaaaactctaaaagctagtagtgacctttgc

SEQ ID NO: 3180 - DNA, 1339 bp, Zea mays
agataatgtagagtgcgccgcgccgtgacggcgcggatgagaaagcctccaaacctctctgtttcgggctctccgtccccggcgtccaacacccatactctccccaggttgtgtgccacacccacactcaactatatacgaaaaccgccggcgcctggcccctaggccctagtcacagacccttgttctttcttcagacgcgcccccgggcatggcgaaccgcagtgttgccatgggcgtggccctcgcgttcgtggccatgaccgcgctctgttgcgcgccgggcgccgcggagttgcccaggctggaccacccggccaggagcgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaaggacggcctcaagggcgtgcgcgaccaggcatttgaagaatcgttcgtggatatctacacagctcaaagcttacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcaccctggcaaggatcgttatgactggagaggggtggcgcctcgaggcaagtacatagccaatttgctgaaggatctggatgtggctatgaagaaatcaactgcaaggtggaagattgtggctgggcatcacaccatgaggagtgtgagtgagcacggggacactaaggagcttctggaattactacttccagtcctcaaggacaatggcgtcgacttctacatcaatggacacgatcactgcctggagcacattagcagcagagacagtccactccagtatttcacgagcggaggcggttccaaggcatggagaggagtcttccatccaaacaaggacaaactccggttcttctacgacgggcaagggttcatgtccctccagctgaaccaagaccaggcgcacttcatcttttacgacgttttcgggaacatactgtaccgatggagctcgagacatccccagccctccacctatctcgatgaggaataaattggattgattttgcgccattgatatgtacaaaacaccgcctgccaactgtcatgtatgtgaaatgatgagtgttagacgcaaagaaggttatacaccagttagggaaaaaaaaaaaaaaaa

SEQ ID NO: 3181 - DNA, 1311 bp, Zea mays
cagaaatcgacgagtgatgtacgtaactgatccagccaccccggtcgagtgccacccactccacggcgccgaatcgcagataatgtagagtgcgccgcgccgtgacggcgtggatgagaaagcctccaaacctctctgtttcgggctctccgtccccggcgtccaacacccatactctccccaggttgtgtgccacacccacactcaactatatacgaaaaccgccggcgcctggcccctaggccctagtcacagacccttgttctttcttcgacgcgcccccgggcatggcgaaccgcagtgttgccatgggcttggccctcgcgttcgtggccatgaccgcgctctgttgcgcgccgggcgccgcggagttgccccggctggaccacccggccaggagcgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaagaacggcctcaagggcgtgcgcgaccaggcatttgaagaatcgttcgtggatatctacacagctcaaagcttacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcaccctggcaagcatcgttatgactggagaggggtggcgcctcgaggcaattacttagccaatttgctgaaggatctggatgtggctatgaagaaatcaactgcaaggtggaagattgtggttgggcatcacaccatgaggagtgtgagtgagcacagggacaccgaggagcttctggaattactacttccagtcctcaaggacaatggcgtcgacttctacatcaatggacacgatcactgtctggagcacattagcagcagagacagtccactccagtatttcacgagcggaggcggttccaaggcatggagaggagtcttccatccaaacaaggacaagctccgattcttctacgacgggcaagggttcatgtccctccagctgaaccaagaccaggctcactttatcttttacgacgttttcgggaacatactgtaccgatggagctcgagacatccccagtcttccacgtatctcgatgaggaataaattggattgattttgcgcc

SEQ ID NO: 3182 - DNA, 1564 bp, Zea mays
gctgtaacctgcaaaccgcgaagcagcaaaagccatcgattggccggcgcgcattccctagcttttctctttctaaaagattatatatagatctctagctagctgtatctgccactatctatatccccgaagagagctgtttgacaaaaaatctagctatttgctctatcatatatcatacgattttagccgctatctgccgttgcagtagtagcctaatttaactgactattagctgtttcaagagatagatccataatcacttggtttggccacagatttaaaacactaccaaaagtccaaaagaatacatatgttcctgctggtggtgccgtgtggtggtgcacacgtactgcacacacagcgcatgcactcggctgtaccaccacccaagcaaaagcgccgctgcttgctagctagtgctcggtgatgacagctgaacagcgactgctttcccatgtgtagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtaggggcagccatgatgtagcaaaaaaaaaaatagtgcaaatattcattatcgaggagtt

SEQ ID NO: 3183 - DNA, 1093 bp, Zea mays
aaaccgccggcgcctggcccctaggccctagtcacagacccttgttctttcttcgacgcgcccccgggcatggcgaaccgcagtgttgccatgggcttggccctcgcgttcgtggccatgaccgcgctctgttgcgcgccgggcgccgcggagttgccccggctggaccacccggccaggagcgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaagaacggcctcaagggcgtgcgcgaccaggcatttgaagaatcgttcgtggatatctacacagctcaaagctcacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcaccctggcaagcatcgttatgactggagaggggtggcgcctcgaggcaattacttagccaatttgctgaaggatctggatgtggctatgaagaaatcaactgcaaggtggaagattgtggttgggcatcacaccatgaggagtgtgagtgagcacagggacaccgaggagcttctggaattactacttccagtcctcaaggacaatggcgtcgacttctacatcaatggacacgatcactgtctggagcacattagcagcagagacagtccactccagtatttcacgagcggaggcggttccaaggcatggagaggagtcttccatccaaacaaggacaagctccgattcttctacgacgggcaagggttcatgtccctccagctgaaccaagaccaggctcactttatcttttacgacgttttcgggaacatactgtaccgatggagctcgagacatccccagtcttccacgtatctcgatgaggaataaattggattgattttgcgcc

SEQ ID NO: 3184 - DNA, 1028 bp, Triticum aestivum
cctccggccagcagccatggcgaggggttccatggccgcggtgctcgccgtcctggccgtggcggcgctccggtgcgcgccggccgccgcggagctcccgctggtggagcacccggccaagaacgacgggtcgctcagcctgctcgtcgtcggggactggggccgcaacggcacctacaaccaatccagggtcgcggagcagatggggaaggtcggggagaggctggacatcgacttcgtggtctccaccggcgacaacttttacgagaatggcctcaccggcgtccatgaccagcagtttgaagaatccttcaccaatatctacaccgcccagagcttgcagaagccgtggtacctcgttctcggaaaccatgactaccggggcgatgcgctcgcacagcttgacccggtcatgcgcaagctcgatgagagattcgtttgcatgagatcatttcttgtcaatgcagagatcgtggagttcttcttcatcgacaccactccattccaactcaagtactggactcaccccaaagacagtcactacgactggagaggagtggcgcctcgaaaggactacatagctaatctgctgaaggatttggatgaggcaatgaagaaatcaactgcaaagtggaagattgctattgggcatcataccatgaggagtgtcagtgaccatggggacaccgaggagctcctgcaattgcttcttccagtcctcaaggttaatggcatcgacttctacatcaatgggcacgaccactgcctcgaacacattagcagcagagacagtccaatccaatacttcactagcggaggcggttcaaaagcatggaggggagtctaccagccaaatgatgataagatccagttcttttatgatgggcaagggttcatgtccctccagctaaaccaggaccaagctgacttcatcttttatgatgtttctgggaaagtcttgtacgagtttacctcgcacaaaacaaaccacttccagccctccatctatgtcactgcagaatgaggga

SEQ ID NO: 3185 - DNA, 1356 bp, Hordeum vulgare subsp. vulgare
gtccgcacctttgttaaacaaaccaaccacacactgccggcgtccccgtccgcgtccggccatcgaccatggcgaggaggagcggcgccggcgcgtccgcggccgtggcgctcgccgtcctggccgtggccgcgctccggtgcgccgcggagctcccgctggtggagcacccggccaagaacgacgggtcgctgagcctgctcgtcatcggggactggggccgcaagggcaccttcaaccaatccatggtcgcagaccagatggggaaggtcggggagaagctggacatcgacttcgtggtctccaccggcgacaacttctacgaggacggactcacgggcgtccatgaccggcagttcgaggagtccttcaccagtatctacacagccaagagcttgcagaagccgtggtacctcgttcttggaaaccatgactaccggggtgatgcgctagcccagcttgacccagtcatgcggaagctcgatgagcgattcgtgtgcatgagatcattcgtagtcaatgcagagatcgtggagttcttcttcatcgacaccactccattccaactcaagtactggactcaccctaaagacagtcactatgactggagaggagtggcgcctcggaaaaactacatagctaatctgctcaaggatttggacgaggcaatgaagaaatcaactgcaaagtggaagattgctgttgggcatcataccatgaggagtgtcagtgaccatggggacaccgaggagctcctgcaattgcttcttccggtcctcaaggttaacggcatcgacttctacatcaatgggcatgaccactgcctggaacacattagcagcagaaacagtccaatccaatacttcactagtggaggcggttcaaaagcatggaggggagtctaccagccaaatgatgataagctccagttcttttatgatgggcaagggttcatgtccctccagctaaacaaggaccaagctgacttcatcttttatgatgtttctggtaaagtcttgtatgagtggacctcgcgcaaaacaaaccacttccagccctccatttatgtcactgcagaatgagggacatgcagatcatggcacgaagaattagtttggtagcgctatttgtgaaaaaattgaatgtgccactgtggtaacagtggtaaaggtaatagagtattaagtatggtgtgtggttccatgctgaagaaatattgaactggatgtgaattgtctacaataaaggagcagagatcagtatggtgtccattggttctgatgcacacataagtccagggatctactgatgcgatgtgcatttagagaaatatgcataaactgagtctaatgttgc

SEQ ID NO: 3186 - DNA, 3407 bp, Sorghum bicolor; identical to SEQ ID NO: 3144

SEQ ID NO: 3187 - DNA, 3601 bp, Zea mays; identical to SEQ ID NO: 3143

SEQ ID NO: 3188 - DNA, 3781 bp, Oryza sativa Japonica Group; identical to SEQ ID NO: 3145

SEQ ID NO: 3189 - DNA, 3608 bp, Hordeum vulgare subsp. vulgare; identical to SEQ ID NO: 3146

SEQ ID NO: 3190 - DNA, 2718 bp, Sorghum bicolor
atggcggatttcggtggcggcgacagcgagctggaggagcaatccaatgaggggtaccaggagccggcgttcgaggccttcatgtgccctctcaccaagcaggtgatgcacgaccccgtgacgatcgagaccgggcagaccttcgagcgggaggccatcctcaagtggttcagggagtgcagggacagcgggaggaagccgacgtgcccgctcacgcaggcggagctgcgcagcaccgacatcagccccagcatcgccctgcgcaacgtcatcgacgagtggagggcaaggaacgaggacaaggagctggacaaggccttcgcctccctcagtctcaccaccacacagcatgctcaagacgacgccgacaccctgcgcgcactcctctacgtctcccaaatgtgccacaggagcgccgccaagaagaccctcgtgcgcaggcaaggcgtcatacccaccatcactgacctgctcaagagcagcagcagaagggttcgcctcaaggccctcgaagtccttcgtctcatcgtcgaggacaacgacgaaaataaggaagagctggggaaaggtgacaccatacgcaccatcatcaagttcctgtccaatgagaatttccaagagagggagcttgcagtttcgctattgtacgagctctcaaagctcgatcctatatgcgaaaggatcggcgcaatctacggggccatactcctactggttgggatggcaagcagcaaatcagagaatggtgtggctgtggagaaagccgagaacacgctcaagaatctggacaagtacgaaacaaacgtcaagcaaatggctgagaacggcaggcttcagcctctgcttacaaaacttattcaaggcacacctcaagttcaggtcgccatggctgaatacctcggcgagcttgcgttggcgaacgacgtgaaggtggtggtggcagagcaggtcggggctctgctcgtgagcatcttgaagacgggcagccttccggcaagagaggccacgctcaaagccctgagggagatatcgtcaaacgagtccagcgccaagatcctgctccaggcgggcatcctgccgccgctggtgaaggacctcttctccttgggcgccggccacctgccgatgaggctcaaggaggtgtcggccgcgatcctggccaacctggtggcgtcgggcgccagcttccggtccatcccgctggacgagagcggggagacgctgctgtcggaggagatggtgcacagcctgctgcacctcatcagcaacaccgggccggccatcgagtgcaagctcctcaacgtcctcgtggggctcaccggctccccgtccacggtggccgacgtggtctccgccatccgcagctccggggccaccatcagcctgatccagttcgtggaggccgcgcaccgggagatccgcgtggagtccctcaagctgctgcgcaacgtgtcgccgtacatgggcgcggagctagcggacgccctcggcctcggaggcagcaccggccacctgggcagcctgctgggggtgatcaccgtcaccgaagaccaccggagcggcgtgacggaggagcaggcggcggccgtggctctgctgggcgacctccccgagagggactggaacctgacgcggcagctgcaggagctgggcgcgttccgggcgctggcgacgaagctggtggagctccggcggggcacgatccgcggcaaccggcacgtggcgcccttcacggagggggcggtgaaggtgctgtacagggtgacgtgcgcgctgcagctgcagctgcaggaagaggaggcggcggaggtgtacgtggagctggcgcgggaggtgggcctggcgccgctcttcgtggagctgctgcagcagcagatgagcagcgggcaggacgccgtgctgctctactcggccatggcgctggagaacctgtcgctgcagtcggcgaggctcacggacgtgccggagccgccgccgccgcctgggagcctcctcatgtgcgggtgcttcgggggccccaggcacaggcacgggcacggcaagcagccgcagccgcagctgcccggggccatggggacgtgccgcgtccacggcggcttctgctcgctgcgggagacgttctgcctggcggagagcgggtgcaaggcggtggagcggctggtggcgtgcctggagcacgcggatgaccgcgtggtggaggcggcgctggcggccttgtccacgctggtgggggacggcgtggccaacgcgacggagggggtgctggtggtcggggaggcggaggggctgcgccccgtggtggaggtgctggtggagaaccggacggaggcgctgcagcggcgggcggtgtgggccgtggagcgcatcctgcgcgtcgaggacatcgcgctggaggtggctgctgaccagaccgtggcctccgcgctcgtggaggcctaccgcaacggcgacgtccgcacccggcagacggcggagcgcgcgctccgccacctggacaggatccccaacttctccagcgccttccaccaggccaaaggcagggcatgaatcaacttcttcctccatttgttgattgatttgccaaaccagactgagtgtctgtgtacgctgatatatataaattgtgtatgtatgcatatatgtccatggcgcatgcacattcattttgttgatccgtgcgtctttgtgtttataaaaccaccattccattgatttggg

SEQ ID NO: 3191 - DNA, 2703 bp, Zea mays
ctctcgagtagtcgcctcgtcttctatcggcccccaaggccctcaccatcggaattggatcggagtggaacaagatggaaggtttctgcggcggcgacagcgagctggacgagcaatccaaccaggagccggcgttcgaggccttcatgtgccctctcaccaagcaggtgatgcacgaccctgtcaccatcgagaccgggcagaccttcgagcgggaggccatcctcaagtggttcagggagtgcagggacagcggaaggaagccgacgtgcccgctcacgcaggcggagctgcgcagcaccgacatcacccccagcatcgccctgcgcaacgtcatccaagagtggagggcgaggaacgaggacaaggagctcgacaaggccatggcttccctcaccgccacacaggaggctcaggctcaagacgacgacgacgacaccctgcgcgccctcctctacgtctcccgcatgaagaagaccctcgtgcgcaggcaaggcgtcatacccaccatagctgacctgcttaagagcagcagtagaagggttcggctcaaggccctccaagtccttggtgtcatcgtcgaggaagacgatgaaaacaaggaagagcttgctaaaggtgacaccatacgcaccatcatcaagttcctgtccaatgagaatttccaagagagggagcttgcagtgtcgctattgtacgagctctccaagttcgaccctacatgcgaaaggatcggcgcaatctacggggccattctcctgctggttgggatggccagtagcaaatcagagcacggtgtggctgtggagaaagcagagaacacgctcaagaacctggagaagtacgaaacaaacgtcaagcagatggcagagaacggcaggcttcagcctctgcttaccaaactcatccaaggtccaccccaagtccagctcgccatggctgaattcctcggtgagcttgcgctggccaacgacgtgaaggtccttgtggcggagcaggtcggggccctgctggtcaccatcatgaagaccgagggcagccttccggcgcgggaggccacgctcaaggccctgagggagatatcgtcgaacgagtccagcgccaggatcctgctccaggcgggcatcctgccgccgctggtcaaggacctcttctccctgggcgccggccacctgcccatgaggctcaaggaggtgtcggccgccatcctggccaacctggtggcgtcgggcgccagcttccggtccatcccgctggaccacagcggggagacgctgctgtcggaggagatggtgcacagcctgctccacctcatcagcaacaccgggcccgccatcgagtgcaagctcctcaacgtccttgtgggcctcaccgcctccccggccacggtgcccgacgtggtctccgccatccggagctccggggccaccatcagcctcatccagttcgtggaggccgcgcaccgggagatccgcgtggagtccctcaagctgctgcgcaacgtgtcgccgtacatgggcgcggagctcgcggacgccctcggcctcgggggcagcaccggcaacctgagcagcctgctcggggtggccacagtcaccgaggaccggagcggcgtcacggaggagcaggcggcggccgtcgctctgctgggcgacctccccgagagggactggaacctgacgcggcagctgcaggagctgggcgcgttccgggcgctggccacgaagctggtggagctccggcggggcacgatccgtggcaaccggcacgtggcgcccttcacggagggggcggtgaaggtgctgtacagggtgacgtgcgcgctggcgctgctgcagcaggaggagacgtacgtggagctggcgcgggaggtggggctggcgccgctcttcgtggagctcctgcagcagatgatgagcagcgggcaggaggctgtgctgctctactcggccatggcgctggagaacctgtcgctgcagtcctcgaggttgacggacgtgccggcgcctcgtcgtgggagcagcctcgtgtgcgggtgcttcgggcagggacggtcgcccccgccccccggggcaatggggacgtgccgcgtgcacggcggcttctgctcgctgcgggagacgttctgccttgcggagggcgggtgcaaggcggtggagcggctggtggcgtgcctagagcatgcggatccccgcgtggtggaggcggcgctagcggcgctgtcgacgctgctgggggacggcgtggccaacgcgacggagggggtgctggtgatcggggaggcggaggggctgcgccccgtggtggaggtactggtggagaaccggacggaggcgctgcagcggcgggcggtgtgggccgtggagcgcatcctgcgcgtcgaggacatcgcgctggaggtggcggccgaccagaccgtggcgtccgttctggtggaggcctaccgcaacggcgacgtccgcacgcggcagacggcggagcgcgcgctccgccacctggacaggatccccaacttctccagcgccttccaccaggccaaaggcagggcatgatccttgcgtttgttttcttgcagcagttccttccccttccttccatttgtttgttcatggaacatagatttgcctgttaccttctttctcttcgtgtacatacccaccatgtatgtgtatgtgtcttgtgttttataaactagcatcatcc

SEQ ID NO: 3192 - DNA, 3000 bp, Hordeum vulgare subsp. vulgare
gggcagctcagcacagcacagctgccgcttcttcttccttcctcccctgcctgcgactttgattgattcagcctcctcgtcgccgccgtcgccctccgttccccattccttcattctcctccgctgattcctcctgcgccgccgacaccgactctcctcctccgcctcctcctccttgctgctgcgccccgcctcctctccgggcagggcagggcctcctcctcctcctcctcctcctctccgggcagggcagggccgccgccgcggcgcagatccaagaaagaaagaaagaaagatagaaagaagctgcaagatgatggcccggaactcggacggcgagctggaggagcagtccaccgagggttaccaggaggcggcgttcgaggccttcatgtgcccgctcaccaagcaggtcatgcaggaccctgtcaccatcgagacgggccagaccttcgagcgcgaggccatcctcaagtggttcagggagtgccgcgacaacggccgcaggcccacctgcccgctcacgcagcgcgagctccgcaccaccgacatcaaccccagcatcgccctccgcaacgtcatcgacgagtggagggccaggaacgatgagaaggaccttgacaaggcctgcaacgccctcaggctgcaccccgaggacgacgaggacgacaccctgcgcgccatggcctacatctcgcagatatgccagcggagcggcgccaagaagaacctcgtgcgcgcccagggcatcatatccacgctcgccgacttgctcaagagcagcagcaggagggtccgcctcaagtccctgcaggtcctccgcaccgtcgtcgaggacaatgatcagaacaaggaagagctggggaaaggcgacaccgtgcgcaccatcataaagttcctgtcgaacgagaacatacaggagagggagcttgcggtttctttgctgtatgagctctcagagtatgagcccgtgtgcgaaaggatcggcgcggtctatggagcgatactcctgctggtcggcatggggagtagcaagtcagagaacatgatggctgtggagaaagcagagaaaacgctcaagaatctggagaagtatgacactaacatcaagcaaatggctgaaaacggcaggctgcagcctctcctcaccaaactgcttcaaggagggcctgaggtgcaggttaccatggttgagtacctcggggagctcgcgttggccaacgacgtgaaggtggtggtggcggagcaggttggaacgctgctggtgagcatcatcaagacgggcggcctgccggcgagggaggcgacgctcaaggcgatgagggagatgtcatccaacgagctgagcgccaagatactgctgcaggctggcatcctgccgccgctggtcaaggacctcttctccgtcggcgccagcagccacttccccatgaggctcaaggaggtatccgccaccatcctcgccaacctggtggcctccggcgccagtttccgctccatcccgctggacgacgccggcaggcagacgctcctgtccgaggacgtggtgcacagcctgctccatctcatcagcaacaccggccccgccgtggagtgcaagctgctcaacgtcctggtcggcctcaccagctccccggacacggcccaagacgtggtgtcggccatcaagagctccggcgccaccatcagcctgatccagttcctggaggcagcccaccgggagatccgcgtggagtccctcaagctcctgcgcaacgtgtcgccgtacatgggcgccgagctcgccgacgcactcggcggccacctcagcagcttgctccgggtgatatccgaccccggcgccggtggcgtgacggaggagcaggcggcagccgtgggcctgctgggtgacctcccggagagggactcgaagctgacgcggcagctgttcgagctgggagcgttcggcacgcttagcacgaagctggcagagctccggcggggcgccatccgcgggaaccggtacacgacgccgctgacggaggggatggtgaaggtgatgtacaggctgacgtgcatgctgcaggaggcgccagagtacgtggagttcgcgcgtgaggccgccctggcgccgctgttcgtggagctggtgcaggtgaacgggcaggacgcggtgcagctctactcggcgctggcgctggagaagctgtccctcgagacgaggaacctgacggtcatccctgaccccccgccgcccgcgccttccgggttcctgtgtgcgtgcttcggggtgccatcgtcgacgggtgctgctgctggtcgtccggtgggggtgtgccgggtgcacggcgggttctgctcgctgcgggagagcttctgcctggctgaaggcggtgccggggggaaggcggtggagcggctggtggcgtgcctggatcacctgaacccggaggtggtggaggcggcgctggcggcattggcgacgctggtgggggacggggtggaggcggcggagggcgtgggcgtgctgggggacgcggacgggctgcggccggtggtggacatcctggtggagaaccggacggaggcgctgcggcggcgggcggtgtgggtggtggagcgcatcctgcgggtggaggacatcgcgcaggaggtggcggcggaccagacggtggcgtcggcgctggtggaggcgtaccgcaacggcgacccgcgcacgcggcacaccgccgagcgcgccctccggcacctggacaggatcccaaacttctccagcgcgttccatgcgcaggcacgccggccatgatcatgaagccacccaccctcttcttcttttgtagtatgtaatgtaatttatttattgtgtaaatgtatgtagcttcattttatttgtttgtttgtatgttgatgaataggataggagtatctatgacatgacaatcacaattggaaacaagatgatgatgatttgttaagttgcaccttgataataaaaaaataaaaacaaacaattattttgac

SEQ ID NO: 3193 - DNA, 2973 bp, Oryza sativa Japonica Group
gttctggctcgcacacagctcagcagctaactagtccaatggagcagctagcaggtgagaaaataaaagccaagaacaagtcgacgtggccgcctttcgttacccaccaacccaacctcgttctacggtacgccacgcctcccctcccctcctccgccgccgccgcctcaattagaccgaagctctaaactccggcgagccctcgccgccgcctgcgtggaggggaggtcgggaggagggggttgatggcgggcgagggcgtggagatgtcggaggaggaaggcgcgttcgaggcgttcgtgtgcccgctgacgaagcaggtgatgcgcgacccggtgacgatcgagaccgggcagacgttcgagcgggaggcgatcctcaagtggttccgcgagtgccgggacaacggccgccgcccgacgtgcccgctcacgcagcgcgagctccgcgacacggaggtgtcgcccagcgtggcgctccgcagcgtcatccacgagtggcgggcgcgcaacgaggagaaggacctcgaccgcgcctgcgcctccctcgtcggcggcttcgccggccacgccggcgacgaggaggaggaggagtccgcgctccgtgccctggtgcacgtctcccagatatgccagcggagcgccgccagcaaggacctcgtccgccgccgcggcgtcctccgcgccgtcgccgagatgctcaagagcggcagccgacggctccgcctcaagtccctccaggtcctccgcgtcctcgtcgaagacaacgacgataacaaggaggagttggggaagggcgacacgatacgcaccatcatcaagttcttgtcgaacgagcatgtccaggagcgggagctggcggtgtcgctgctgcacgagctgtccgggcacgagccgacgtgcgagcggatcggcgcggtgtacggcgccatcctgctgctggtcgggatggggagcagcaagtcggagagcgccgtcgccgtcgacaaggcggagagcacgctccgcaacctcgaccgcttcgacgccaacgtcaagcagatggccgacaacggcaggctgcagccgctcctcaccaggctgctccgcggcgagcccgacacgcgggtcgccatggccgactacctcggcgagctcgccctggcgaacgacgacaaggccgcggtggccgagcaggccggcccgctgctggtggggatgctccggaccggcgccacgccggcgaaggaggccacgctcaaggcgctcagggagatctcatccagcgaggcgagcgccaagctgctgctgcagcgcgccggcgtcctgcccccgctcgtcaacgatgtcctcttctccacgggacacctaccgatgaagctcaaggagctcgccgccaccatcctcgccaacctcgtcgcctcaggcgccgatttccgttccatcccactcgacgacgacgaagacgacgacggcggcggcggcggacgtgggcgccgcaggacgctcctgtcggaggacgtcgtgcatagccagctccacctcatcagcaacaccggccccgccatcggatgcagactcctcagcgtcctcgccgggttgaccagctcccgcgcgacggtggccgacgtcgtcgcggcggtcaagagctccggcgccacaatcagcctcatccagttcatcgaggcagcgcaccgggacatccgcgtcgagtccctcaagctcctgcgcaacctcgccccctacatgggcgccgagctcgccgacgccctgggcggaagcctgagcagcctcctccgggccatctcctccgacggcggcggcgtcacggaggagcaggcggctgccgtggggttgctcggcgacctcccggagggtgactccagcctgaccaggcagctgttcgacctgggcgcgttcagggcgctggccccgaagctggcggagctccggcggggcaccatccgcggcgggaaccggtacgtgacgccgctgacggagggcgtggtgaaggtgatgtaccgggtgacgtgcgcgctggaggaggacgcggagtacgtggagttcgcgcgggaggccggcctggcgccgctgttcgtcgagctgctccacaccaacggcatggacacggtgcagctctactcggcaatggcgctggagaagctgtcgctgcagtcgagccacctgacggccatcccggcgccgccgtcgccaccggcggggttcgggtgcgcgtgcttggggaggagacccgcggcggcggcggtgcccgcgggggtgtgccgcgtgcacggcgggttctgctcgctgcgggagacgttctgcctggcgcaggcggacggcgggaaggcggtggagcggctggtggcgtgcctggaccacctggacgggagggtggtggaggcggcgctggcggcgctgtcgacgctggtgtgcgacggcgtggacgcgagggaaggggtggtggtgctgggggaagccgacgggctgcgcccggtggtggacatcatggtggagagccgcacggaggcgctgcagcggcgggcggtgtgggcggtggagcgcatcctgcgggtggaggagatcgccggggaggtggccgccgaccagacggtggcgtcggcgctcgtcgaggcgtaccgcaacggcgacccgcgcacccggcagacggcggagcgcgcgctccgccacctcgaccggatccccaacttctccgccgccttccaatccaaacgctcatagcctctccacagatctgccattgccaatgtgcaactgcaactctgcaaggctctcccttcgctgattatcccattcccctctttcatttcacttgctctttttcccattcccctctcacttcacttgctcttttgctggatcggattgctgatttttttttcttttttttggtttgtttacagcagcatgatgcttgtatagcataatcgtcttaattctttcaaagcaaaatggatgaaacaaaattggttgc

SEQ ID NO: 3194 - DNA, 2554 bp, Oryza sativa Japonica Group
ggcgggcgagggcgtggagatgtcggaggaggaaggcgcgttcgaggcgttcgtgtgcccgctgacgaagcaggtgatgcgcgacccggtgacgatcgagaccgggcagacgttcgagcgggaggcgatcctcaagtggttccgcgagtgccgggacaacggccgccgcccgacgtgcccgctcacgcagcgcgagctccgcgacacggaggtgtcgcccagcgtggcgctccgcagcgtcatccacgagtggcgggcgcgcaacgaggagaaggacctcgaccgcgcctgcgcctccctcgtcggcggcttcgccggccacgccggcgacgaggaggaggaggagtccgcgctccgtgccctggtgcacgtctcccagatatgccagcggagcgccgccagcaaggacctcgtccgccgccgcggcgtcctccgcgccgtcgccgagatgctcaagagcggcagccgacggctccgcctcaagtccctccaggtcctccgcgtcctcgtcgaagacaacgacgataacaaggtcgcaaatcccatccatcccccaaatttcaacctccccccaaaccaagcgagaattgatcgattcttggttttgattttgcaggaggagttggggaagggcgacacgatacgcaccatcatcaagttcttgtcgaacgagcatgtccaggagcgggagctggcggtgtcgctgctgcacgagctgtccgggcacgagccgacgtgcgagcggatcggcgcggtgtacggcgccatcctgctgctggtcgggatggggagcagcaagtcggagagcgccgtcgccgtcgacaaggcggagagcacgctccgcaacctcgaccgcttcgacgccaacgtcaagcagatggccgacaacggcaggctgcagccgctcctcaccaggctgctccgcggcgagcccgacacgcgggtcgccatggccgactacctcggcgagctcgccctggcgaacgacgacaaggccgcggtggccgagcaggccggcccgctgctggtggggatgctccggaccggcgccacgccggcgaaggaggccacgctcaaggcgctcagggagatctcatccagcgaggcgagcgccaagctgctgctgcagcgcgccggcgtcctgcccccgctcgtcaacgatgtcctcttctccacgggacacctaccgatgaagctcaaggagctcgccgccaccatcctcgccaacctcgtcgcctcaggcgccgatttccgttccatcccactcgacgacgacgaagacgacgacggcggcggcggcggacgtgggcgccgcaggacgctcctgtcggaggacgtcgtgcatagccagctccacctcatcagcaacaccggccccgccatcggatgcagactcctcagcgtcctcgccgggttgaccagctcccgcgcgacggtggccgacgtcgtcgcggcggtcaagagctccggcgccacaatcagcctcatccagttcatcgaggcagcgcaccgggacatccgcgtcgagtccctcaagctcctgcgcaacctcgccccctacatgggcgccgagctcgccgacgccctgggcggaagcctgagcagcctcctccgggccatctcctccgacggcggcggcgtcacggaggagcaggcggctgccgtggggttgctcggcgacctcccggagggtgactccagcctgaccaggcagctgttcgacctgggcgcgttcagggcgctggccccgaagctggcggagctccggcggggcaccatccgcggcgggaaccggtacgtgacgccgctgacggagggcgtggtgaaggtgatgtaccgggtgacgtgcgcgctggaggaggacgcggagtacgtggagttcgcgcgggaggccggcctggcgccgctgttcgtcgagctgctccacaccaacggcatggacacggtgcagctctactcggcaatggcgctggagaagctgtcgctgcagtcgagccacctgacggccatcccggcgccgccgtcgccaccggcggggttcgggtgcgcgtgcttggggaggagacccgcggcggcggcggtgcccgcgggggtgtgccgcgtgcacggcgggttctgctcgctgcgggagacgttctgcctggcgcaggcggacggcgggaaggcggtggagcggctggtggcgtgcctggaccacctggacgggagggtggtggaggcggcgctggcggcgctgtcgacgctggtgtgcgacggcgtggacgcgagggaaggggtggtggtgctgggggaagccgacgggctgcgcccggtggtggacatcatggtggagagccgcacggaggcgctgcagcggcgggcggtgtgggcggtggagcgcatcctgcgggtggaggagatcgccggggaggtggccgccgaccagacggtggcgtcggcgctcgtcgaggcgtaccgcaacggcgacccgcgcacccggcagacggcggagcgcgcgctccgccacctcgaccggatccccaacttctccgccgccttccaatccaaacgctca

SEQ ID NO: 3195 - DNA, 1392 bp, Zea mays
ggctcctccttttccgttgccccggcgtgctcctcttctcttctcttctctgcctgcccatccgcacatccatccactaatattggcagagcggcgtccgagtggaaacggcagcagacgaaaagcccaagcagaccacgcattgatcgcagctcatcatcaaccatcaatcatcatcatcacggcggcgcgcacgtcgtcgtactgctctgctagccagccctttgtatttaagccgacgctctgctgggctcgcttctcccttcctctccgctcgtctccgctagctagctgcaccatcgtgcatgcgttcccggccgccgcgccgcccgcctgcaggacccgcgctgccgatcgacgtcggtgcacaatgtggaactgctcgtcgctcctgctgcagtacggcgacgactacgcagccaggtgcgagagctctagttcaccggcaggagctgtgggcctggacaggatactagcggcggagtatggccggttcgattctctggacctgtcgccgccgccgccgcttcacggtcttcaggcgcagacgctttttgctattcacggttcttcagagaactgcctaggaataggcgcgaatccaatctacagcaccgaggcccggcccgcgttctcgcagctcagcttcacccagccagctgctgataccgctgcccactactcgatgaaatggacggcagcgggggagacggcgaccggtggcgggggaagccgtctcaggggatcgaagaggctcaagacaaagacgccagccacagcacaaggtccacagcaccacggccagcggtgcagtccgaaaccaacaacaagtcagtctatcaaggcaccaccatgtaagaggagccagaagctgggggacaagatcacggcgcttcagcagctagtctccccttatggcaagacggatacggcatcagtgctccacgaggcagccacctgcatcaagcacctccacgagcagatccagttctccagcgtcacagcaggacacgggcgacgaagagggcggcgcgacgggtctgcgccggcgaggcctgtgcgtggcgtcgctgtccccggccgtcgtgcagctcgtgtcggccgaggccgcgctcggcaaccgcgacacggaagaccactggcgctggctcggcactctgtaagtctgtagccggggcggagaacgatgctgtgctgccatgcttcagttcgtagacggtaggagcacgagacatggccgcaggggttggtgtcatcaggccttcagatacagcgttagacctcaatttcactggggaaaaaataaatattactcacctgcttcgagaggttattagttagtacaatggatatattatatactacattaatacgtcaccttctgttttatcc

SEQ ID NO: 3196 - DNA, 3003 bp, Zea mays; identical to SEQ ID NO: 3151

SEQ ID NO: 3197 - DNA, 4608 bp, Zea mays; identical to SEQ ID NO: 3150

SEQ ID NO: 3198 - DNA, 2992 bp, Sorghum bicolor; identical to SEQ ID NO: 3148

SEQ ID NO: 3199 - DNA, 3813 bp, Sorghum bicolor; identical to SEQ ID NO: 3147

SEQ ID NO: 3200 - DNA, 3111 bp, Zea mays
ctagtccaccggcgatttgttgttttgttcttcagtgcgtcagccaaccttaactgctacgatcggtcgatcaagggggaggaagtttctggagctctgcccatggcgtcggcgatgaagctgctggggagatcttccttggcgagccctgctgccgcggcgcccggacgggagcggcgaggcgggccctgcttcgccgcggtcggaagggaggggagcgcgcacaggaggaggtcgtcgctgaggtcgaccgcgccggtgggcgcgctggccgagcgggtcgtggtgacgccggcgccaccggagagggccggggcgggccccccggagccgcacccccagagcgtggccgcgcgggccgtggtcaccgtgcggcggaggcggaaggaggacgccaagcgccgggtcgccgagcagctggacgcgtacgccgaccgggttggccgcagtgtcctcctcgagctcatcagcacggagaccgacccaagaaaggggggccccaagaagagcaggcgctcggcgctggtgggctggttcgagaagaaggacgtcaagacggagcgggtggtgtacacggcggacttcaccgttgacgggtccttcggcgagccgggcgcggtcaccgtgctcaaccggcaccagcgcgagttcttcatcgagagcatcgtggtggagggctttccctccggccccgcgcacttcacctgcaactcgtgggtgcagcccacccgcgtggaccgcaacccgcgcgtgttcttcaccaacaagccgtacctgccggccgagacgccgccgggcctgcaggagctccgccgccagcagctcagcgacctgaggggcgagggtgccgacaccggcgagcgcaggatcaccgaccgggtgtgggagtatgacgtgtacaacgacctcggcaacccggacaagggcgccgagttcgcgcgcccggtcctcggcggcgagcagcagctgccgtacccgcggcggatgcgaacgggccggcccaagaccatcacaggcaagcctccgctttcccacgaccgcgcggagagccgggtggagtacccggagcccatctacgtgtcccgggacgaggagttcgaggacgggaagaacgagatgctgtcggagggcgcgctcaaggcgctgctccataacttcatgccgctgctggtgagctccgtgtcgcctgacatccgcgacttcgccggcttccacgacgtggacaacctcttcaaggagggcctccgcctgaagcaggccctgcaggaccagctgttccagaagatccccttcgtgcgcaagatccaggagaacagcgagggcctcctccgctacgacactcccgacatcatcaagagtaagccagcgcccatgcgccttcctcctcctccgtccatgatccatggagaggacaagtttgcttggctgcgggacgacgagttcgcgaggcaggcgctggctggcatcaaccccgtcaacatcgaacgtcttcaggcgttcccgccgatgagcaagctggacccggccgtgtacggcccgccggagtcggccatcacggaggagcacatcatcggacagctcgacggcatgtcggtgcagcaggcgctgcaggacgacaggctgtacatgctggactaccacgacatcttcatgccgttcctggaccggatcaacgcgctggacgggcggaaggcctacggcacgcgcacgctcttcttcctgacggccgcgggcacgctgaagcccatcgcgatcgagctgtgcctgccgccgatgaccgacgggtgcgcgcgcgccaagcgggtgttcacgccgcccgccgatgccaccagcaactggctgtggcagctcgccaaggcacacgtctgctccaatgacgccggcgtccaccagctcatcaaccactggctgaggacgcacgcggccatggagccgttcatcatcgcggcgcaccggcacctgagcacgatgcaccccatcttcaagctgctcaagcctcacatgcggtacacgctcaagatcaacgcgctggcgcggcagatcctcatcaacggcgacggcgtcatcgagtccgggttcacccctggccgctactgcatggagatgagctcgttcgcgtaccgggagctctggcggctagaccaggagggcctccctgccgatctcatcagaagaggaatggccgtggaggacccgacgcagccgcacggtctccggctgctcatcgaggactacccgtacgccaccgacgggttgctgctctggtcggccatcaggcggtggtgcgacgcctacgtggccatgtactacccgtccgacgagtccgtgcagggcgacaccgagctgcagtcgtggtacagggaggccgtgcacacggggcacgcggacaagcgcgacgcgccgtggtggccgcgcctgtcgacgcccgcggacctggcgtcgctgctgacgacgctgctgtggctcacctcggcgcagcacgcggcgctcaacttcgggcagtacccgctgggcggctacatcccgaaccggccgccgctgatgcggcggctggtgcccgccgagggcgacccggagtacgcgcacctggtggccgacccgcaccgcttcttcctgtcggcgctgcccagcctgacgcagaccaccacgttcatgaccgtcatcgacacgctgtccacgcactccgccgacgagcagtacctcggggagcggcctgatgaggcgtggacggccgacccggcggcgttggcggccgcgcgcgagttcgcggacgaggtgcgccgcgccgaggaggagatcgaacggcgcaacgctgacactggccgccgcaaccggtgcggcgctggcgtgctgccgtacgagctcatggcgcccacatcggggccgggcatcacctgccgcggcgtccccaacagcgttaccatttagcctctcagtaccgacagacagccatgggcgcatgacagagatgatctgaaaggagattttttttccactcattatagtcgggtggggagaaatctaagcagaagcaaatgaattctgcattatttctccccccatttccaaattgccattgatttggtggtccgaaacaagaaaaaaaaaaaa

SEQ ID NO: 3201 - DNA, 3903 bp, Zea mays; identical to SEQ ID NO: 3149

SEQ ID NO: 3202 - DNA, 3123 bp, Hordeum vulgare subsp. vulgare; identical to SEQ ID NO: 3153

SEQ ID NO: 3203 - DNA, 3110 bp, Hordeum vulgare subsp. vulgare; identical to SEQ ID NO: 3152

SEQ ID NO: 3204 - DNA, 3442 bp, Hordeum vulgare subsp. vulgare; identical to SEQ ID NO: 3154

SEQ ID NO: 3205 - DNA, 760 bp, Sorghum bicolor
atgtatgaatttaatttctcccttccccctgattatgcgctggtgataagagcgcttggttctctagaagggacggcaaaagcactggatcctgagtttaaagttattgagagtgcatatccttttgtgattgggaggctccttgcagaccccagccctgatatgaggaaaatattaagggagcttcttatacgtgacgatggatccatcagatggaatcgactggaaaggctgattgcagctatatctgaacagtcatcagaatcttcaagcacagtgggagctgactctagtgagaatgccaatggaagtcctgagtggagatcatttgatatgcattctgtgattgcagctacagaagacctatttgatttcattttatcgaggaaaggatggcgggttcgggttttccttgtccaggatattgttaaagcttcagatgtgtttcttcaagaagcaacattcccgtatatatttgacaatgtgggaaagataggggacataaatccagagagaagtaagatgatcaggaggctggtgaatacagtgcaatcgttccgtcaagctatcagtttggctccagatgcttggagtgccatgctaatccgtactttgttgaagcacgaggcacaaaaatttgttcttgatgtgtttttgaccctggctagccattccagttacaagattccagaaacattctggctttgtatgtcaagatttctaaattacttggacaaacaagatacgttttaggaacagc

SEQ ID NO: 3206 - DNA, 1531 bp, Sorghum bicolor
ctctctccagcagcaccacagcactcccctcgcattgttcttgatcccatccttccatccagtactacgattctcgctccctctccaagatcaatcaaaggtcggagaagaaggaattcagggttagggagccagccatggggtgcttttcatgctgctgcgtggccgatgacgacgacattggcaggaggaagaagcatgacgatgcctacgttcctatccctgctcaagttgataactttggacctagccggcccccagccccaatccctgtcatccccacaggcagagatcagccaattgcagtaccgcccattcatctggaagagttgaaggaaattacaaagaacttcagcagtgatgccctcattggtgagggctcgtatgccagagtctatttcggtgtgctgaaagatgggacgaaatctgcagtgaagaagcttgactccagcaaacagcctgatcaagaattccttgtgcaggtttcagctgtctcaagattgaagcatgagaatgttgtccaactcgttggatactgcgctgaagggatcacccgcgttcttgcttatgagtatgcaacaaggggatcattgcatgatatcctccatggtaaaaagggtgtcaagggagctcagccagggccagtcctgtcatggatgcagcgagcgaggattgccgtaagtgcagctcgtgggctcgagttcctccacgagaaggcggactctcgagtggtccaccgcgacatcaagtccagcaacatactgctctttgacaatgacgttgccaagatcggggactttgacatctcaaaccagtcccctgacatggctgcgcgcctccactctactcgtgttcttggcacctttggctaccatgcaccagaatatgccatgactggacagcttagcaccaagagtgatgtttacagctttggagttgtgctgttggagcttttaaccggtcgcaagccagttgaccacacactgccccgtggccagcagagccttgtgacatgggctacaccgaggcttagtgaagacaaggtgaagcaatgcgtggatccaaggctcggagatgaataccctccaaaggctgtagccaagatggctgctgtggccgccctgtgcgtgcaatacgagggtgaattccgtcccaacatgagcatcgtggtcaaggccctgagccccttgctgcacagccggcccggcaaccgccccgctgcctcgccggcctcccccgctgcagcagcagcagcagcagcagcagagcgatctggactgtgattcctcatcaccaaagatggccatggtcctgtgtgcgacgtgacgactttgggttgaggaagaagagaccgtcttgtggagcgttgcgttgcgttgcgttgctgtgtcaagactgttttaagtcttggcgccgagaagagctttgccatgcggctgtgtattgttgtaagcgctgtcccctgctttgtgtgtctgtcatcaacctgttctagaaaatggtgtgcgagggatcatggatggatgatacc

SEQ ID NO: 3207 - DNA, 1586 bp, Zea mays
caaggagaaggggaagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcgcctcctggtttgtgtgccctgtcatcatcctattctattctagaaaatggtgtacgatggatcatggatgataccaactatttggtctcttttggaatgcgaaaatgcagcacttggcttcc

SEQ ID NO: 3208 - DNA, 1634 bp, Zea mays
gccaggccaggtaacccacaacacaaggagaaggggaagggcggcgagggaagggctccgcgtcgcgtcccttctcttcctcctcctctctccaacaccccatccatcagcgctgccctccgcattgctcttgatcccatccagtacatcgattctccccccaagatcaaaggccggagaaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccattggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtgaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcgcctcctggtctgtgtgccctgtcatcatcctattctattctagaaaatggtgtacgatggatcatggatgataccaactatttggtctcttttggaatgcgaaaatgcagcacttggcttccgtaaaaaaaaaaaaaaaaaaaaaaaaaaaaa

SEQ ID NO: 3209 - DNA, 1634 bp, Zea mays
gccaggccaggtaacccacaacacaaggagaaggggaagggcggcgagggaagggctccgcgtcgcgtcccttctcttcctcctcctctctccaacaccccatccatcagcgctgccctccgcattgctcttgatcccatccagtacatcgattccccccccaagatcaaaggccggagaaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcaatgaagaagcttgactccagcaaacagcctgatcaagaattccttgtgcaggtttcagctgtctcaagattgaagcatgagaatgctgtccaactcgtcggatactgcgccggagggagcacccgcgtccttgcttatgagtatgcaactaggggatcattgcatgatatcctccatggtaaaaagggtgtgaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcgcctcctggtttgtgtgccctgtcatcatcctattctattctagaaaatggtgtacgatggatcatggatgataccaactatttggtctcttttggaatgcgaaaatgcagcacttggcttccgtaaaaaaaaaaaaaaaaaaaaaaaaaaaaa

SEQ ID NO: 3210 - DNA, 2631 bp, Zea mays
ggatgcttttcatgctgctgtgtggcagatgacgacaacgttggcaggaggaagaagcatgacgatccctatgttcctatccctgctcatggttgtcacttctctctctctttcttttcattacttcttgtatcatggtcgcgacgattaatttgtgaatttcaataaaaaagttaattgtgtgatataatcaaggcactgacttcacaaaatgtggatgtcactacctgatcgaacaatgcaaagggggtggtactctgtctgttttcgatgatcaattaattcgcagaaacttctttgtcataagaaatgcagttacctttctgacgttagcttacccagctttctgcctttcttaaacaaagagggaatggataaacatgccagtcaattgtactcgttcgtgcacctaaattcattcgtattcagtcctcgttacattacattattttgttaagaaaactattctaaaggaccagcatgctatgaattcttcacgaacttgactcatgatctgtgtttcgtttctgttgaatccttattacgttatagtatttggttgattttctctatccaaattcgatatagtcttcggcacgactaaatatgatttacttcactggaaacctacctgtcctggtgtgtcaaataatgtatccaaaaagatccatgcgaattgattgctgatggttgtactgaactctgcaatgtgattgccaactatttggactgtggtggtactaaagggttttgttttgtgtaccctatgacacaataatcctgttcccctgaaacatacaagatattgttttagttattttccaggtctggttcaacggaaacataaatatttaaacaaacatttatcatgcttgctagtaccacaaaaagggcttcctgtgcatatatcatgatggtcatttctgtttttttcctttatgcagtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggttgtgccacctatccttctctcatgtaacgtttcctggtcaagatgctccagctctgactcccatttttttttgcaggtttcagctgtctcaaggttgaaacatgagaatgttgtccaactcgtcggatactgcgccgaagggagcacccgcgttcttgcttatgagtatgcaactaggggatcattgcatgatatcctccatggtagggagaaagtattccatgtccttacataagctcagtgtttttaccattctcattgcttgcgaaaacatttatctacttccataatgagatactttttgcagttgctcccatgcttactactatgaaccggttgctgatgcctaatttaatcaagcctgctgagtttgggctgacgtgtgcctgatccatgtccacaggtaaaaagggtgtcaaaggagcccagccagggccagtcctgtcatggatgcagcgagctaggattgccgtatgtgctgctcgaggtctcgagttcctccacgagaaggccgatcctcgagtggtccaccgagacatcaagtcaagcaacatactgctctttgaccatgatgttgcgaagatcggggacttggacatctcaaaccaggcccctgacatggctgcgcgcctccactctactcgcgttcttggcacctttggctaccatgcaccagagtacgtattccaaatgtgatttcatctttagtcaggatttgggaataccgtcttacccttttttttctggggttttttcagatatgccatgactggacagcttagcacgaagagtgatgtctacagctttggagttgtgctgctggagcttttaactggtcgcaagccagttgaccacacactgccccgtggccagcagagccttgtgacatgggtatgggccttagattttttttttgttctatgtttttttgacaaggatgaaaggcataaagccaacaaagcaactaaattcttggttatatatgaaggctacaccgaggcttagtgaagacaaggtgaggcaatgcgtcgatccaagagtcggagatgaataccctccaaaggctgtagccaaggtaaatatatcatattaccaagttaaggaactagacttattcccatgtaaacctgaaagtagagtttcacaacataacacttaactgatcctgctccgaaaagcactgcagaagttttgataatatgtggcttggatggacaaaagatcaccacaaatctagcatttaaactgtgttttgtttttgtgcaccagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgcagcagcagagcgatccggactg

SEQ ID NO: 3211 - DNA, 1809 bp, Oryza sativa Japonica Group
gagcgtaggttcttcccatttggcggttggcagcggaaggaaaggagagaaaagagggggggaaggccaggccaaccggagcgaaggaaagccagggagtaataaatcgagagagaaacggccaaaaaagaaaccaacaacaagaaagaaatcaagcaagcaagaagagacgagacgagggagagaaggagaagagggggccggccgcgggcgtcgtcgtgttcctccccccctctctctcctctcctctcctctcgatctccatccttccttccatccattcctccccgcacccttcgcattgctctcgtcgtctcgattcggtcgaggatctccaggaaaagaggaggaagcgatatgggttgcttttcatgctgcggagcggatgatgtcggcaagaagaagaagcgcgacgatccttacgtcccgatccctgatccaggtggtaactatggacgtagcaagcccgggcccccagccccttcgcgttctccccccaccagcagaaatctgccaattgcagtaccggcaattccccttgatgaaataaagggaataaccaagaacttcagcagtgatgctctcatcggagaaggctcgtacgccagagttttctttggtgtgctgagagatggcaggagatctgcggtgaagaagctcgactccagcaaacagcctgatcaagaattccttgtgcaggtttcagccgtttcacgactgaagcatgagaatattatccaacttatcggatattgcgctggagggagcatccgtgttcttgcttatgagtatgcaccgaggggctccttgcatgacattctccatggtaaaaagggtgtgaagggagctcagccaggaccagctctatcatggatgcagcgagtgaagattgccttgagtgctgcaaaggggcttgagttcctgcacgagaaggcggagcctcgtgtcgtccaccgtgacatcaaatccagcaacattatgctctttgacaacgatgttgcgaaagtaggagacttcgatgtatccaatcagtccccggacatggcggctcgcctccactccactcgtgttcttggcaccttcggttatcatgctcctgagtacgcgatgacagggcagcttagcacgaagagcgatgtctatagcttcggagtcgtgttgctggagcttttaactggtcgcaaaccggtcgatcatacgctgccccgtggccagcagagtcttgtgacatgggctactccaaggctaagtgaagacaaggtgaagcaatgcgtggatccaaggcttgaaggggattatcctcccaaggctgttgccaagatggctgccgtagctgcgctgtgcgtgcagtacgaggcggacttcaggcccaacatgagcatcgtcgtcaaggctctgaacccactcctcaacagccgcccgaacaatcgccccgcctccttcaccgacgccggcgagcgatccggattatgagcacgccatgaccatttttctcatcggactccggtgacaccacgacgacgggagggaaggctcggtttccatggattccaaatgtgtaaaaattcagtggaaatgaagagggtagctctgctgctgcctgtcttgttcttgcctcgatctccagactcctgttgctgtaaattgtcgcaatccctcctgattatgtgttcctctcgacctcttgtagtagtttgagaaatggatgaatatatatacttcttgcttgtccacttttagcttccactgtcaccagacaagttttgttgttctgcgtacaatgggcagattaataattctcatctcatc

SEQ ID NO: 3212 - DNA, 1330 bp, Sorghum bicolor
gcggcggcgcggcgcggcgcggcgctatcccctccgcggctctgcgcgcagtcgtgacggcagcagcagcggggcggcggcggcggcgcggcgtgcgtccctgctgtgagcttccccgtgtcaggctagctcaggctgacagtgtaccacaacgtcagtcgcacgaccccggaactcggacaaccctcgcggctcgcgcagccctctcccgctcccatggatccaccgcaagagtcggccgctgccggccggaagaggcgccggcgaggaggcgtccggaatcgcaaaaagctttcctcgcagaaggggcttcctccagcggctgcgcccccaacgccggcgtccccaccggtgaagcggcggcgcaaggacgtcgctggccaggccgccgccatgccgaagagaggcaacacctcgagcctactcgacaagatgcgtgcaaggttatctggtggccatttcagaatgttaaatgagaagctatacacttgcagtggagaggatgcgtttgactacttcaaaaatgaccctaatctttttgatgtgtatcatacaggatatcaagagcagatgtcacactggcctgaacagccagtgaatgtaataatcaattggttgaagagtcacaatgcatcatggactgttgctgattttggctgcggcaatgccacagttgcaaaaaatgtgaagaacaaggttttctccattgatcttgtttcagatgatccttcagtgattgcgtgtgatatggctcatactccattggagccatcttctatagatgttgcaatattttgtctctctttgatgggaatcaactatccaagttacttagaggaagcaaatagggttctcaagccaagtggttggcttgttattgctgaagtgcgaagtaggctagacccgaacaacggaggtgctgatcctgaaaagttttctaaagccattatcgagcttggcttttcacttgtttcaaaggatgtgaaaaataaaatgttcattctattctacttcaggaaaaaggaaaaaagtaagctggcaaagagcatcgattggccccagctgaaaccgtgcttgtacaagcggcgatgagccgattgtctcgtatccactagtaatactgtagttgtagtagcgctcgttaaaagtttcgtcaaactgaagtatcgtcttgattaggttcctccgtacctgtatggctgtatctgtatcccagtctattccattattttctgcgtctttcatgtattggacctcacaagaaaagatcacctataggggacgatgcattgcatggaagtataattcaagtctacgtttcacatgctgc

SEQ ID NO: 3213 - DNA, 1398 bp, Zea mays
cagaggaggatgatgcattgtcacagttgtctaactgtgccctaacacagaccggagcgtcgcggcgctatctcctccgcggctctgcgcgcagtcgtgttggcaactgcagcggggcggcggcgtgcgtccctgctgtgagcttcatcgccccgtatcaagctagtttaggctgtcagcgggccacaacttcagccacacaacccggaactccgacaaccctcgcggctcgtgccgccctctcccgctcggtcgttcccatggatccaccgcaagagttggccgccgccggccgcaagcggcgccggcgaggaggcgtccggaaccgcaaaaggctttcctcgcagaaggggctccctccagcgactgcgcccccaacgccggcgtccccacctgtcaagcggcggcgcaaggacatcgctggacaggccgctgctatgccgaagagaggcaacacctcgagtctactggacaagatgcgtgcaaggttatctggtggccattttagaatgttaaacgagaagctatacacttgcagtggagaggatgcatttgactacttcaaaaacgaccctaatctttttgatgtgtatcatacaggatatcaagagcagatgtcacactggcctgaacagccagtgaatgtaataatcaattggttgaagagtcagaatgcgtcatggactgttgctgattttggctgtggcaatgcagcagttgcaaaaaatctgaagaacaaggttttctccattgatctcgtttcagatgaaccttcagtgattgcttgtgatatggctcatactccattggagccatcctctatagatgttgcaatattttgtctttctttgatgggaatcaactatccaagttatttagaggaagcaaatagggttctcaaaccaagtggttggcttgttattgctgaagtgcgaagtaggctagacccgagcaacggaggtgctgatcctgaaaagttttctaaagccattatccagcttggcttttcgcttgtttcaaaggatgtgaaaaacagaatgttcattctgttctacttcaggaaaaaggaaaaaagtaaggtggcgaagagcatcgattggccacagctgaaaccgtgcttgtacaaacggcgatgagccgcttgtctcgtatccaccagtaatactgtagttgttgtagtagagctcttcaaaagtttcgtcaaaactgaaagtctagatttaggtccctccgtacctgtatggctgcatctgtgtgccacgctattccattattttccacattagctgcgtctttcatttgttggacctcacaagaaaagatcacatagggaacgatgcattgtttggaagcagatcatatataattcaagtctacttttcaaaaaaaaaaaaaaaa

SEQ ID NO: 3214 - DNA, 879 bp, Oryza sativa Japonica Group
atggagcctctgcaggaggcggcggcggcggcagccggcggccgcaagcggcgccgccgaggaggcggccggaaccgccgaaagcaccaggcttcgtcctcttcgggggcggcggcgtcggcgtccccgccctcccctcctgcgaagcggcagcgcggggacgacgccgcgcccaagggacggggcagcaagccgaagcccgcgagcctcctcgacaagatgcgtgcaaggttatctggtggtcatttcagaatgttaaatgagaaactatacacttgcagtggacaagatgcatttgactacttcacaaatgagcctgatctttttgatgtgtatcatgcaggatatcgagagcaaatgtcgcattggccagagcaaccagtaaatgttataatcaattggttgaagagtcatagtgcatcttggacagttgcagattttggctgtggcaatgcagcagtttctaaaaatgtgaagaacaaggttttctccatcgatcttgtttcagaggacccttcagtcattgcctgtgatatggctcatactccattggagtcatcctctgtagatgtggcaattttttgtctgtctttaatgggaacaaactatccgagttatatagaggaagcaaaccgagttctcaaaccaagtggttggcttcttattgctgaagtgaggagtaggctagacccaaacactgcaggtgctgatcctgataaattttgtgaggccatcagcaagcttgggttttcccttgtttcgaaggatgcgaaaaacaaaatgttcattctgttccatttccggaaaaaggaaaagagtaaggtggtcaaaaacatcgattggcctcagttgaaaccttgcttgtacaaacggcgatga

SEQ ID NO: 3215 - DNA, 2673 bp, Sorghum bicolor
atgaggaagctcttcttctccgagtcggcctgcaaggagaccaagctccactccgcgccccactcatggctgcccctcgagagggggaagctctccaagttctccggccatgccgccgccagctcctccatagattccttgatgaagatgccggagccggcggtgcttccgcacttcaagccggccgactatgtcgacatactggcacagatacacgaggagctggagtcctgctctcctgacgagaagtcctgcctgtacctgctccagttccaggtcttccgcggccttggtgaggccaagctgtcgcggaggagcctccagtccgcgtgggagaaggcgagcaccatccacgagaagctcatctttggggcgtggctcaagtatgagaagaaaggggaggaggccattgccgacctgcttagctcgtgtggcaagtgctcgcaggagttcaggctgctggatttcgtgtcgcaggtctccactgggtcacatgtgatgagctatgatgatgatgatgatgagtctgatgagtttcagggttctgcggtggttcatttccggataagagatgacatgattgcatgtgatcggaggaagctcgcggctttgtcaactccgctttatgcaatgcttaacggtggatttagggaatcgtatctggaggtcattgacatgtctagaaatggcatctccccaattggcatgagggcaatcagtaaattcagtctatcaggaagactaccatacttgtccgctgatgctatcttggagatgcttgattttgccaataagttttgctgcaagggcctcaaggatgcctgtgagcgaaagcttgcttctttcgtctcttcaaggcaagatgctatagacttcatggagtgtgctcttgagctgggctgttccatccttgctgcttcgtgcttgcaagtgctcttgaatgagcttccagagtgcttgaatgatgaacaagtggttaggatattctcctctgcaaataaggcacagagattgacaatggttggcaatgcatctttctccctatattgccttcttagtgaagtctccatgagtaccaacccgacatcggatgtcactgtaagtttcttggaaaagctggtagagtcagcatcagattctaggcagaaacaactagccttacatcagctggcatgcaccagatttctaaggaaagattaccctgaatctgagcgcctgttcaatgctgccttttctgccggccatctctattcgttagtgggtttggctagattggccgctctgaggggtaataagcattttgctctcaagtttctagactctgttatgtcatctcggtggcctcttggttggatgtatcaagagagagcactatatttggaaggtgataacaagttagaaaatcttaacaaggctacagagttggaccctactcttacatatccctatatgtttcgagctgcatctttgatgaaaaggcaaagtgttgaagctgcattgatggagatcaaccggatccttggattcaagctggtgctggagtgcttagaactgaggttctgttgctaccttgctcttgaggattatagggctgccttatgtgacgtgcaggcaatcctcactcttgccccagattatcgtatgattggtggccgggttgctgccaagcagctgcgaatgctagtgctagagaatgtagagcagtggacagctgctgactgttggatgcaactttatgatcgctggtcatctgtggatgatatagggtccctctctgttatatatcaaatgctggagtcagataatgccaaaggagttttgtactttaggcaatctttgcttcttctcagattaaactgtcctgaggcggcaatgaggagtttgcagcttgctcgtgagcatgcttcaagtgatcatgaaaggcttgtctatgaaggatggatattgtatgatactggccactgtgaggaaggactgcagaaagcagaagcatcaattgcaatacaaaggtcatttgaggcattttttctgaaagcttatgctttggccgattcaagtcttgatccttcgacctcagcaacagttgtatcacttctagaagatgcattgcggtgtccctcagatagacttcggaagggtcaggctctaaacaacctcggaagtgtttatgtggattgtggaaagctagacctggcagctgaatgctacattaacgccctaaagattggccacaccagagcgcatcaaggccttgcaagggttcatttccttcggaacaacagagctggtgcatacgatgaaatgaccaagctgatagagaaggccaggaacaatgcatcagcatatgagaagagatccgagtactgcgaccgggagctaacaaaaacggacttgcagatggtcaccaaactggaccctctgcgagtctatccctacagataccgtgctgctgtgctgatggacaaccacaaggagaaagaggccatcgcggagctgaccaaggctatcgccttcaaggcggacctgaacctgctccacctgcgcgcggccttccacgagcacattggcgacatctcgagcgccctccgggactgccgcgcggccctttcggtggaccccaaccaccaggagatgctggagcttcaccaccgggtgaacagccaggaaccctga

SEQ ID NO: 3216 - DNA, 4322 bp, Oryza sativa Japonica Group
ggaagctcttcttctccgagttgacctcctgcaaggagaccaagctccactccgcgccccactcatggcttcccctcgagaaagggaagctctccaagttcgccggccactccacctcctccatgtaagttctctctctctctcttgctgttacatgatgcgtttggcttgttctgaatcctgctactttagttagttacctggtctttgttagtagtactttgtgtagagagagattcacaaaattcagattttactggtatagttctgaagagctttgctggctggttggttggttggttgtgatgttcatcaatttgattcttggtgggttgtggttgtggtgcagagaatcgctgatgaaaatgccggagccggtggttcttccccacttcaagcctgcggattatgtggacatattggcccagattcatgaggagctggagtcttgccctcctgatgagaagtcgtgcctgtacctgctccagttccaggttttccgcggcctcggcgaggtgaagctgtcgcggaggagcctccagtccgcgtgggagaaggcgagcacgatacacgagaagctgatattcggggcatggctcaagtatgagaagaaaggggaggagccgatatccgacctcctcagctcgtgtggcaagtgctctcaggagttcaagctgctggatttcgtgtcgcagatctccaccgggtcgcatgagataagctatgatgatgagtcggatgtgttttggggctctccggtggtacatttccggataagagatgatatgattgcatgcgatcggcgaaagcttgctgctttgtcgactccgctgtatgcaatgcttaacggtggctttcgggaatcacatcttgaggttattgatatgtctcggaatggcatctcctcgattggtatgcgagcaatcagtaaattcagcttgacaggaaggttaccgtatttatcagcagatgctattttggaaatgcttgattttgctaataagttttgctgcaatggcctcaaggatgcttgtgagcgaaagcttgcttctttcatttgctcgaggcaggatgctatagacttcatggagtgtgctcttgagctgggttgttccatccttgctgctgcatgcttgcaggtgctcctgaatgagcttccagagtgcttgaatgatgaacaagtggttaggatattctcctgtgcaagtaagcagcagcgatccacaatggctggaaatgcttctttctccctatattgccttcttagtgaagtctccatgagcatcaacgcgacatcggatgtcacggtgaccttcttggaaaaattggtggattcagcatcagattctagacagaagcagttggccttgcatcagctggcgtgcacaagacttctaaggaaagattatgctgaagccgagcgcctgttcaatgccgcctttaccgctggacatctctattcagtagtgggtttggctagactggcctctatgaggggtaataagcatttttctctcaagttgcttgattctgtcatgtcatctcgctggccacttggatggatgtaccaagagagagcactatatttggagggtgataacaagttggaaaatcttaacaaggccactgagttggatcctacccttacatacccctacatgtttcgagctgcatctttgatgaaaagacaaagcgttgaagctgcccttatggagattaaccggatcctgggatttaagcttgttctggaatgcttagagctaaggttctgttgctatcttgcacttgaggaccatagagctgctttatgtgatgtccaggcaatcctcactcttgctccagattatcgtatgattggtggtcgggtgtctgcaaagcagctgcgtatgcttgtgatggagaatgttgagcagtggacaactgctgactgttggatgcagctttatgatcgttggtcatctgtggatgatataggatccctctcggtcatatatcaaatgctggagtcagatgctgctaaaggagttctctactttaggcaatctttgcttcttctcaggtaacttaattaacttattttattgcacagaataagagttagcatgattaaaaaatgatacagcacatcagtgattagcattgtagatgtatagcacatggtttgcattgcctggcatgtcttacaccttctagtgtgtggattcatttggaatgccaaactaccagatggtttatcagcatagttgcacatgcctcctgaccaacttacatcatggtctaattcttgtgctagaatctcagggatgttgtgattaatactattttaacctttttttttcagattaaattgtcctgaggctgcaatgcgcagtttgcagctagctcgtgaacatgctgcaagccaacatgaacagcttgtttatgagggatggatattgtatgataccggccactgtgaggagggactgcagaaagcagaagcatccatcgcaatacaaagatcatttgaagcattctttctgaaagcttatgctttggctgattcgagtcttgacccttcaacttcagcaacagttgtatcacttcttgaagatgcattacgctgcccctctgatagactacggaagggtcaggtatggctttatgacttcattttcttccacatcctttcatcaattctacttagctaaacagaccatgcatgataacaagttgctgtcctgtttctgctgtgacataatgcaaattctgagatcatatttctcataacaaaaataggaatactttatacccttgtagcacattctgaagtagtcaaacaaaggtttcaaattgggttcttggtacatgaagtgtaattttaccttgttgagttatcttttaataccttcgtacttgaggcataatggcataatatgcatttgttcattttccaaattcgttggttgttatttagatcaggtgttgttgctccacctatgttaggaagttaagatgtcctattcattattgaattattaatgcaaatggcgctctcactattaaaattggctgtcctggtgctcataacatgccaaccatcaattcttctcataggtgcactgcaagcgtgatttgatttcctatcaagtatctaacatgtttctaagttatgagttatgacatctgataccattgatgctactgataattgccaaccatatggatgagtggactgacttaaatgaaactttgctctcttttttttcatcagtttagctaaatggaccgaccagccacaatcagtacttttttctatcagcttaagctgacagtgtacattttatttctgtaacattggttgacccaatctgcagcattgtatttgatttgagatgttcgcgaatggtacatcttattcatcgtaatgtgtgacatcttgtaggctctgaacaaccttgggagtgtttatgtggattgcgggaagcttgacctggcagctgaatgctacatcaatgccctaaagattggtcataccagagctcatcaaggccttgccagggtccatttcctcagaaacagcagaactggtgcatatgaggaaatgaccaagctaatagagaaggccaggagcaacgcatcagcttatgagaagaggtcggagtactgtgatcgtgagctaacaaaatcagacctgcagatggtgaccaaactagaccctctgcgtgtatacccctacagataccgtgctgctggtaagcaccgcttcctgcctagcaaatcttgtttgttatgatataggtatgactgagacaagatttgtcatgatagcaaaccaccagtttcaaagcaggttgaaacttggatataaaatcgtggtcacagtagtttaatttgttagtagatgtagctcatcggtgtccaactcccagaggtttgtgctattataactaaccaactactccttttcctatcataagctggtaagaagtcaatgttgtttggcaatattctatgctcaacttgatcagttggtgtaacaaccacatatttcactcagttcaaaaattagctcatctgtttgatattctcatgcatcttttttcgctgatctggaatcctcagtgctgatggacaaccacaaagagaaggaggccatcgcggagctgacaaaagcaatcgccttcaaggcggacctgaacctgctccacctgcgagccgccttccacgagcatgtcggcgacatctcgagtgcactccgggactgccgcgcagcgctctccgtggatcctaaccaccaggagatgctcgagcttcatcaccgggtgaacagccaagaaccc

SEQ ID NO: 3217 - DNA, 2876 bp, Oryza sativa Japonica Group
aagggaagctctccaagttcgccggccactccacctcctccatagaatcgctgatgaaaatgccggagccggtggttcttccccacttcaagcctgcggattatgtggacatattggcccagattcatgaggagctggagtcttgccctcctgatgagaagtcgtgcctgtacctgctccagttccaggttttccgcggcctcggcgaggtgaagctgtcgcggaggagcctccagtccgcgtgggagaaggcgagcacgatacacgagaagctgatattcggggcatggctcaagtatgagaagaaaggggaggagccgatatccgacctcctcagctcgtgtggcaagtgctctcaggagttcaagctgctggatttcgtgtcgcagatctccaccgggtcgcatgagataagctatgatgatgagtcggatgtgttttggggctctccggtggtacatttccggataagagatgatatgattgcatgcgatcggcgaaagcttgctgctttgtcgactccgctgtatgcaatgcttaacggtggctttcgggaatcacatcttgaggttattgatatgtctcggaatggcatctcctcgattggtatgcgagcaatcagtaaattcagcttgacaggaaggttaccgtatttatcagcagatgctattttggaaatgcttgattttgctaataagttttgctgcaatggcctcaaggatgcttgtgagcgaaagcttgcttctttcatttgctcgaggcaggatgctatagacttcatggagtgtgctcttgagctgggttgttccatccttgctgctgcatgcttgcaggtgctcctgaatgagcttccagagtgcttgaatgatgaacaagtggttaggatattctcctgtgcaagtaagcagcagcgatccacaatggctggaaatgcttctttctccctatattgccttcttagtgaagtctccatgagcatcaacgcgacatcggatgtcacggtgaccttcttggaaaaattggtggattcagcatcagattctagacagaagcagttggccttgcatcagctggcgtgcacaagacttctaaggaaagattatgctgaagccgagcgcctgttcaatgccgcctttaccgctggacatctctattcagtagtgggtttggctagactggcctctatgaggggtaataagcatttttctctcaagttgcttgattctgtcatgtcatctcgctggccacttggatggatgtaccaagagagagcactatatttggagggtgataacaagttggaaaatcttaacaaggccactgagttggatcctacccttacatacccctacatgtttcgagctgcatctttgatgaaaagacaaagcgttgaagctgcccttatggagattaaccggatcctgggatttaagcttgttctggaatgcttagagctaaggttctgttgctatcttgcacttgaggaccatagagctgctttatgtgatgtccaggcaatcctcactcttgctccagattatcgtatgattggtggtcgggtgtctgcaaagcagctgcgtatgcttgtgatggagaatgttgagcagtggacaactgctgactgttggatgcagctttatgatcgttggtcatctgtggatgatataggatccctctcggtcatatatcaaatgctggagtcagatgctgctaaaggagttctctactttaggcaatctttgcttcttctcagattaaattgtcctgaggctgcaatgcgcagtttgcagctagctcgtgaacatgctgcaagccaacatgaacagcttgtttatgagggatggatattgtatgataccggccactgtgaggagggactgcagaaagcagaagcatccatcgcaatacaaagatcatttgaagcattctttctgaaagcttatgctttggctgattcgagtcttgacccttcaacttcagcaacagttgtatcacttcttgaagatgcattacgctgcccctctgatagactacggaagggtcaggctctgaacaaccttgggagtgtttatgtggattgcgggaagcttgacctggcagctgaatgctacatcaatgccctaaagattggtcataccagagctcatcaaggccttgccagggtccatttcctcagaaacagcagaactggtgcatatgaggaaatgaccaagctaatagagaaggccaggagcaacgcatcagcttatgagaagaggtcggagtactgtgatcgtgagctaacaaaatcagacctgcagatggtgaccaaactagaccctctgcgtgtatacccctacagataccgtgctgctgtgctgatggacaaccacaaagagaaggaggccatcgcggagctgacaaaagcaatcgccttcaaggcggacctgaacctgctccacctgcgagccgccttccacgagcatgtcggcgacatctcgagtgcactccgggactgccgcgcagcgctctccgtggatcctaaccaccaggagatgctcgagcttcatcaccgggtgaacagccaagaaccctgagccccccattgttgtacatacaggagctctacatagccaaccataccccaagtgtatgttttgtaccatacacagcagatcaatgtaaggatagtagccaatttaggccctccacccccaaaaccaacccaattccttgtgtccttaattagaatatgttgctcatcatagagtcctttttttagtaaattattatatttttgtgattaagcccccctcctaattgtaccctccatgtgccctcccccaaccccatgttcccaacaagttttgactatctcatgtgtaaatgaaaaatgg

SEQ ID NO: 3218 - DNA, 3422 bp, Zea mays
ggagaccaagctccactgcgcgccccactcatggctgcccctcgagagggggaagctctccaagttctccggccatgccgccgccggctcctccatagaggcattgatgaagatgccggagccggcagtgcttccgtacttcaagcccgcgaactatgtcgacatactggctcagatacacgaggagctggagtcctgccctcctgacgagaagtcctgcctgtacctgctccagttccaggtcttccgcggccttggggaggccaagctgtcacggaggagcctccagtctgcgtgggagaaggcgagcaccatacacgagaagctcatctttggggcgtggctcaagtacgagaagaaaggggaggaggcaatctccgacctgctcagctcgtgctgcaagtgctcacaggagttcaggctgctggattttgtgtcgcaagtctccactgggtcacacatgatgaactatgatgatgatgatgatgagtctgatgagtttcggggttctgcggtggttcatttccggataagagatgatatgattgcatgcgatcgacggaaacttgcagctctgtcaactccactgtatgcaatgcttaacggtggatttagggaatcctatctggaggtcattgacatgtctagaaatggtatctcccctattggcatgagggcaatcagtaaattcagcctatcaggaagactaccttatttgtcagcagatgctatcttggagatgcttgattttgccaataagttttgctgcaagggcctcaaggatgcctgtgagcgaaagcttgcttctttcatctcttcaaggcaagatgctatagatttcatggagtgtgctcttgagctgggctgttccattcttgctgctttatgcttacaagtgctcttgaatgagcttccagagtgcttgaatgatgaacaagtggttaggatattctcctctgcaaataaggcacagagattgacaatggttggcaatgcatctttctccctatattgccttctcagtgaagtctccgtgagtaccaacccaacatcggatgtcactgtgagtttcttggaaaaactggtagagtcggcatcagattctaggcagaagcagctggccttacatcagctggcatgcaccagatttttaaggaaagattaccctgaatctgagtgcttgttcaatgctgccttttctgctggccatctttattcgttagtgggtttggctagattggcctctctgaggggtaataagcattttgctctcaagttgctagactctgtgatgtcatctcggtggcctcttggatggatgtatcaagagagagcactctatttggatggtgataacaagttagaaaatcttaacaaggctactgagttggaccctacccttacatatccctatatgtttcgagctgcatctttgatgaaaaggcaaagtgttgaagctgcattgatggagataaaccggatccttggatttaaactggtgctggagtgcttagaactaaggttctgttgctaccttgcccttgaggattatagggctgccttatgtgacgtgcaggcaatcctcactcttgccccagattatcgtatgattggtggccgggttgctgccaagcagctgcgaatgctagtgctagagaatgtagagcagtggacacctgctgactgttggatgcaactttatgatcgctggtcgtctgtggatgatatagggtccctctctgttatatatcaaatgctggagtcagagactgccaaaggagttttgtactttagacaatctttgcttcttctcagattaaactgtcctgaggcggcaatgaggagtttgcagcttgctcgtgagcatgctgcaagtgatcatgaaaggcttgtctatgaaggatggatattgtatgatactggccactgcgaggaaggactgcagaaagcggaagcatcaattgcaatacaacggtcatttgaggcattttttctgaaagcttatgctttggctgattcgagtcttgatccttcgaccacagcaacagttgtatcacttctagaagatgcattgcggtgtccctcagatagacttcggaagggtcaagctctaaacaaccttggaagtgtttatgtggattgtgggaagcttgacctggcagctgaatgctacattaacgccctaaagatcggccacaccagagcgcaccaaggccttgcgagggttcatttccttcggaacaacagagtcggtgcgtatgatgaaacgaccaagctgatagagaaggccaggaacaacgcgtcggcatacgagaagagatctgagtactgcgagcgggagctgacgaaaacggacttgcagatggtcaccaaactcgaccctctgcgagtctacccctacagataccgtgctgctggtaagtgccgtttgcccgcttcctgctgcatggcatatctagtttcttatacttttaatacgacaaagctaggacgtgatgtgatcctagccccaccagattcaaagcaggttgaaacttagaatataaaaattcttgacacggtagtttattaattgttaatggatgtagctcatgtgtgctcaactcccaagtggttggtgctactttaacgaaccaactaccatggttcctaacataaaagctggtgagaagtcaatgtatgtagcctgccgctgcctacgttcaattttctatcagtaggtgtaacaaccataatatatttgcatccagcccacgaattagctcacccgttccttgtttttctgtttcctgctttgctgacgcggactcgttcctaactcgattattggcgcgcagtgctgatggacaaccacaaggagaaagaggccgtcgcggagctgaccagggcgatcgccttcaaggcggacctgaacctgctccacctgcgcgcggccttccacgagcacatcggcgacatctcgagcgccctccgggactgccgcgcggccctcctggtggaccccaaccaccaggagatgctggagctgcaccaccgggtgaacagccaggaaccatgagcggagcgccgccatggtgtacatacaggacgtgataggaagcccctcatagccaaccccccgccataccagtgtatgttttgtaccatacacagcatgtcaatgtaaggatagtagaaaagccactttaggtccctccctggctccctccccttgcaaaccaaacacctacattccttgtgtgcctagttagatatgttgtttgccatatagcctttcccttagtaaattattgttgtcgactgtgattaagcctcctaattgtacccgccacgtggcccgtgctgccagaatcaagaagttttgactgtaccttctgtatgtaaatgcaatgggggaaaaatgatgaatggaagcttttgtc

SEQ ID NO: 3219 - DNA, 2904 bp, Vitis vinifera
  misc_feature (1917)..(1940): n is a, c, g, or t
atgaagaacctttttccttctgaatcatgtaaagaaacacagctcaatgcctttaatccacagtcatggctccaagttgaaagagggaagctttccaaattctcatcacagtcctcttcttccatagaatctcttatcaaggttcctgagccacccatacttccattctttaaacctgtcgattatgtagaagttctagctcaaatccatgaagaacttgagtcatgtcctccacaagagaggtcgaatctttatttattacagtttcaggtctttaggggccttggggaagttaaactgatgcggagaagtctccgttcagcttggcagagagccagtactgttcaggagaaactcatttttggggcatggctgaagtatgaaaagcaaggagaagagctcattgctgacttacttgcctcttgtggtaaatgtgcacaggagtttggcccaatagacattgcctctcaacttcctgcagattcaaatacaagttccaatgaggctgttgtgatgaatgggaatgaaattttgaaaactgtcattttccgaattggggatgagaaaattgtttgtgacaggcagaagattgcgggcctgtcagctccttttcatgctatgcttaatgggtgtttcacagaatcactccaagaggacatagatttgtctgaaaataacatttcaccatcaggtatgagggcaatccatgagttctgtatgacaggcagtttaggtgaagtcccaccagatcttttgttagagatattaatatttgggaacaaattttgctgtgagaggctaaaagatgcttgtggcaggaaacttgcatctttggtttcctctagagatgatgctgtggaactcatagactatgcacttgaagagaactcccctgtccttgctgcatcatgtttgcaagtgtttttacatgaacttcctgattgtttgaatgacaatcgagtgctggaaatattaagtgatgctaatagacaacagagatcaatcatggttgggcctgcttcattttcactctattgtttcttaagtgaagttgctatggcccttgatcctcggtcagatacaacagcttgtttcttggaacgattggtagagtctgctgagagtagccggcagagattgttggcatgtcatcagttgggctgtgtgaggcttctgaggaaagagtatgatgaagctgaacagctctttgaggcagctctaaatgcaggccatgtatactctgtcgcaggtttagtgagactgggttaccttaaggggcataaactttggtcttatgacaaactcagctctgtgatttcctcttttactccacttggatggatgtatcaggagaggtcactgtattgtgaaggcgataagaggtgggaagaccttgagaaagcaaccgagttggacccgacacttacttacccctacatgtatcgagctgcttccttgatgaggaaacagaatgttcaagctgctcttgcagaaatcaatcaggtcctaggtttcaagctagcattagaatgtttggaactccggttttgtttctatctagcggttgagaactatgaagcggcattttgtgatgttcaggcaattcttacgctctccccagactataggatgtttgagggacgggttgcagcatcccaacttcgcatgcttgtgcgtgagcatgttgagagttggacaacagcagattgctggctacagttgtatgatcggtggtcttcagttgatgatattgggtccctctctgttatctaccagatgcttgaatctgatgctgcaaaaggtgttctttacttcagacagtctttgcttctcctgaggttgaactgcccagaagcagccatgcgaagtttacagcttgcccgtcagcatgcatctaatgaacatgaacgtctagtnnnnnnnnnnnnnnnnnnnnnnnntacaggtcactgtgaggaagggcttcggaaagcagaggagtctattggccttaaaagatcttttgaggccttcttcttgaaagcctatgcattggctgactctagccaggatccatcatgttcatcgactgttgtttcacttcttgaagatgccttaaagtgcccctcagataggcttcgcaaaggtcaggcccttaacaaccttggcagcgtgtacgttgactgtgggaaattagagttggctgctgattgctacatcaatgccctcaaaatccggcacacccgagcccaccagggccttgctagggttcatttcctcaaaaatgataagactgctgcatacgttgaaatgaccaaactgattgagaaggccaggaacaatgcttctgcctatgagaaaaggtccgagtactgtgaacgtgaactcacaaaggcagatctggagatggtcactagattagacccgcttcgggtttacccttacagatatcgagctgcagttttgatggacagccacaaagagaaggaagcaatagcagaactgtcaagagcaatagcattcaaggcagaccttcaccttctacacctgagggcagcctttcatgagcacattggagatgtgttgggcgcactgcgagactgtagagctgccctctctgtggatcctaaccatcaagagatgttggagcttcatagccgtgtcaacagccatgaaccatgacccatgacccatcaacccagacaaaaggaaaaaagattgaaacatagaaaaagcaagaaaatattgtcaaatgcctcgatcacccaccatcacaaccttgtatactagtgaccttctgcatttagccttctcattatcttctatctccctcatttttctttttcttttttttttcttttgatttttgtaatttatgctttgagatttttggtaatataatttaatgaataccaaaattatgca

SEQ ID NO: 3220 - DNA, 3515 bp, Solanum lycopersicum
gccgcctggcggccgcgggaattcgattggacactgacatggactgaaggagtagaaattttatctgtttatcattcttgatcttaaaaaagaaatcttttttatgattctggttgagaaaatattaagattttgtgggttttgatgtggctattctaggttaatctgtaaattagttcttccctgatgggggattttgtgttatcagttttgaactgtgattttcatcttaacaaaatcaggtccttacccggacctcgtacatagctttagtgcttattttttgatctcaacaagttcagagtcttgtgattctgagtgtgagagagctgttgtattattttggtttgctgtttaagttttggattgtcgggtagaacccttgtggctactgtggagatctgggacttgcttaatctgttatgtcccatgagaacttttttcccttcagagtcttgtaaagaaacacatctgaaatcaattaatcctcagtcatggctccaagttgaaagagggaagcttgccaaaatttcatctgaatctgcttcttctatagattccttgatcaaggtcccagaaccaccaattcttccattctttaaacctgttgattatgttcaagttttagcaaaaatccatgaagagctcgaatcatgttccccacaagagagatcaaatctctatttgctgcagtttcaggtctttaagggcctcggagaagttaaattaatgaggagaagccttcgcgcagcttggtcgaaagcaagtacagtttatgaaaaacttgtatttggggcgtggttgaaatacgagaagcaagatgaagagctcatctctgacttgctttctagttgtggcaagtgcgcaaaggagtttggagcaatagacatagcatctgaaatgcctgcctataagaaattaagttctcatggagtcatcaccacaaatgaggattcttgtccaagaactgtttcttttagaattgcggatgagaaaatagcatgtgacaggcagaaaattgccagcctttcagctccatttcataccatgctcaatggctgcttcacagaatcattttgtgaggaaatagatttgtctgaaaacaatatttcacccctggcaatgagattgatcaatgaattcagctcaaccggtttattgaatgaagtgtcccctgatctgctgttggaaatattggtatttgccaataagttttgttgtgaaagcctcaaggatgcttgtgaccgaaagctcgcgtctttaatttcatgtcgacaagatgctctagaactccttgaatgtgcccttgaagagaactcccctgtccttgctgcgtcatgtttgcaagtatttttacgtgaactcccagattctctgaaagacagtcaagtagttgaactgttaagcaatactaccaggcaacaaaggtcaattatgataggtcctgcctcattttcactctattgtttgttaagtgaagtttcgatgaaccttgatcctagatcagatgaatctgttcgttttttgagaacactggtagattcagctgaaaccagccaacagaaaatggtcgcatatcatcggttaggatgcgttaaatttcttagggaagagcttgatgaagctgagcaactgtttgaggctgcttttaatttgggtcacacttattcagttattggtttggctagattaggtcaaataaggggtcataaacgctgggcatatgagaagctcggttctgttatttcttcctcaattcctcttggatggatgtaccaagagagctcgctatattgtgaaggagaaaagaggtgggatgaccttgaaaaagcaactgagcttgatcctacactgacatacccctatatgtatcgagctgcatccttgatgaggaagcaaaatgctcaagctgctctttcagaaataaacagaatccttggattcaaactggcattggagtgcttggaactccgcttttgtttttaccttgctctagaggattaccaattagcaatatgtgatatacaggcaatcctcacactttgcccagattatcgcgtgtttgaaggacgagttgcagcatcgcaactccgtactctgctgcgcgagcatgtagagaattggacagaagctgattgttggctgcagttgtatgatagatggtcgtcagttgatgatattggatctctttcagtaatataccagatgctcgagtctgatgcagcaaaaggtgttctttacttcagacagtccctgcttctcctccgattgaattgtccagatgcagccatgaggagtttacagttggctcgccagcattcatctagtgaacatgaacgtctggtttatgagggatggatcttatatgatactggacactgtgaagaaggtctacagaaagcagaagagtccattagcatcaagagatcttttgaagcattcttcctgaaagcgtatgctttagctgactctagccttgatgcatcttgttcatcaactgtcatatcacttcttgaggatgccttgcgatgcccttcagataggcttcgcaaaggtcaggccctgaacaatctwggcagtgtgtatgtcgactgcggtaaattggatgctgcagctgattgctacattaatgcccttaaaatccggcatacccgggctcaccaaggtcttgctcgtgtacatttcttgagaaatgataaggtggctgcttatgatgaaatgaccaaactgattgagaaggccaagaataatgcatctgcctacgagaagagatcagaatactgtgaccgtgaccgcacaaaggctgacctagagatggtcactcgtctagatcctcttagagtttacccttacagatatcgagctgcagttctgatggacaaccaccaggacaaggaagccattgaagaactttcgagggccattgcatttaaagccgatcttcatcttttacacctgcgagctgcttttcatgaacatataggtgatgttatgggtgcattgcgagattgtcgagctgctctctctgtcgacccaaaacatcaagaaatgttggaacttcatagtcgtgtgaacagtcaagaaccttgaaagaaatgactaatgagcaacaagacaatatatgcaaggacaataggagggggaaacttgtgtctcttatttgaggacacaaaagtgtaaaattaattgagaaagacttttctccctttttccttttttctacctccattggatgccacaagcatctccttgtttatcttagttccaaaattttgtaatatgctccaaaattctgttaatattatttatattaatgaaaatctttattctctctagaattatttgttaactagtttctaggtacgtgtgtttgcacgtgtgtcatgtgttaattagcagtattgagtaactaaattttgaaagagaagtataattgtttgtacttatatacaatcaattgaattggtctatatatgtgatattttttatccaaaaaaaaaaaaaaaaaaaaaaaa

SEQ ID NO: 3221 - DNA, 3687 bp, Solanum lycopersicum
caacactttcccttttaccaaatgacacaaaagaaaagtgaaagactgaatttttcttcagaaaatctcacgccttagcagtctttatctcagttttgtgtaattgaagctcaaaacagtaagtggggttgtcttgattttttctttttttgatttgggagttattatttctgctgatctgttatatatttcaagaacaaggtaagtgttttaggtatttgatatctggggagatttggttgatttactgtggttttgggtgtgttgtgtttgttgatcttacgtaatctttttttgggtctttagtcttttttggttcctttttgggttatgtatattgctgaatctgacttttttagggggaaaaggtcaatggagtttaaggttttatctgtttatcattcttgatcttaaaaaagaaatcttttttatgattctggttgagaaaatattaagattttgtgggttttgatgtggctattctaggttaatctgtaattagttcttcctgataggggattttgtgttatcagttttgaactgtgattttcatcttaacaaaatcaggtccttacccggacctcgtacatagctttagtgcttattttttgatctcaacaagttcagagtcttgtgattctgagtgtgagagagctgttgtattattttggtttgctgtttaagttttggattgtcgggtagaactgtggctactgtggagatctgggacttgcttaatctgttatgtcccatgagaacttttttcccttcagagtcttgtaaagaaacacatctgaaatcaattaatcctcagtcatggctccaagttgaaagagggaagcttgccaaaatttcatctgaatctgcttcttctatagattctttgatcaaggtcccagaaccaccaattcttccattctttaaacctgttgattatgttcaagttttagcaaaaatccatgaagagcttgaatcatgttccccacaagagagatcaaatctctatttgctgcagtttcaggtctttaagggcctcggagaagttaaattaatgaggagaagccttcgcgcagcttggtcgaaagcaagtacagtttatgaaaaacttgtatttggggcgtggttgaaatacgagaagcaagatgaagagctcatctctgacttgctttctagttgtggcaagtgcgcaaaggagtttggagcaatagacatagcatctgaaatgcctgcctataagaaattaagttctcatggagtcatcaccacaaatgaggattcttgtccaagaactgtttcttttagaattgcggatgagaaaatagcatgtgacaggcagaaaattgccagcctttcagctccatttcataccatgctcaatggctgtttcacagaatcattttgtgaggaaatagatttgtctgaaaacaatatttcacccctggcaatgagattgatcaatgaattcagctcaaccggtttattgaatgaagtgtcccctgatctgctgttggaaatattggtatttgccaataagttttgttgtgaaagcctcaaggatgcttgtgaccgaaagctcgcgtctttaatttcatgtcgacaagatgctctagaactccttgaatgtgcccttgaagagaactcccctgtccttgctgcgtcatgtttgcaagtatttttacgtgaactcccagattctctgaaagacagtcaagtagttgaactgttaagcaatactaccaggcaacaaaggtcaattatgataggtcctgcctcattttcactctattgtttgttaagtgaagtttcgatgaaccttgatcctagatcagatgaatctgttcgttttttgagaacactggtagattcagctgaaaccagccaacagaaaatggtcgcatatcatcggttaggatgcgttaaatttcttagggaagagcttgatgaagctgagcaactgtttgaggctgcttttaatttgggtcacacttattcagttattggtttggctagattaggtcaaataaggggtcataaacgctgggcatatgagaagctcggttctgttatttcttcctcaattcctcttggatggatgtaccaagagagctcgctatattgtgaaggagaaaagaggtgggatgaccttgaaaaagcaactgagcttgatcctacactgacatacccctatatgtatcgagctgcatccttgatgaggaagcaaaatgctcaagctgctctttcagaaataaacagaatccttggattcaaactggcattggagtgcttggaactccgcttttgtttttaccttgctctagaggattaccaattagcaatatgtgatatacaggcaatcctcacactttgcccagaatatcgcgtgtttgaaggacgagttgcagcatcgcaactccgtactctgctgcgcgagcatgtagagaattggacagaagctgattggtggctgcagttgtatgatagatggtcgtcagttgatgatattggatctctttcagtaatataccagatgctcgagtctgatgcagcaaaaggtgttctttacttcagacagtccctgcttctcctccgattgaattgtccagatgcagccatgaggagtttacagttggctcgccagcattcatctagtgaacatgaacgtctggtttatgagggatggatcttatatgatactggacactgtgaagaaggtctacagaaagcagaagagtccattagcatcaagagatcttttgaagcattcttcctgaaagcgtatgctttagctgactctagccttgatgcatcttgttcatcaactgtcatatcacttcttgaggatgccttgcgatgcccttcagataggcttcgcaaaggtcaggccctgaacaatcttggcagtgtgtatgtcgactgcggtaaattggatgctgcagctgattgctacattaatgcccttaaaatccggcatacccgggctcaccaaggtcttgctcgtgtacatttcttgagaaatgataaggtggctgcttatgatgaaatgaccaaactgattgagaaggccaagaataatgcatctgcctaccagaagagatcagaatactgtgaccgtgaccgcacaaaggctgacctagagatggtcactcgtctagatcctcttagagtttacccttacagatatcgagctgcagttctgatggacaaccacaaggacaaggaagccattgaagaactttcgagggccattgcatttaaagccgatcttcatcttttacacctgcgagctgcttttcatgagcatataggtgatgttatgggtgcattgcgagattgtcgagctgctctctctgtcgacccaaaacatcaagaaatgttggaacttcatagtcgtgtgaacagtcaagaaccttgaaagaaatgactaatgagcaacaagacaatatatgcaaggacaataggagggggaaacttgtgtctcttatttgaggacacaaaagtgtaaaattaattgagaaagacttttctccctttttccttttttctacctccattggatgccacaagcatctccttgtttatcttagttccaaaattttgtaatatgctccaaaactgttaatattatttatattaatgaaaatctttattctckcwawaaaaaaaaaaaaaaaaaaaaaaaaaaaaaaa

SEQ ID NO: 3222 - DNA, 1345 bp, Sorghum bicolor
ctttgcatgcatattgctctctctgtgtgtgttactgcgtgcaaattaaagcagcagctcttgctcgatcgcgggatgatgtctgagaggaatctccttgcacgccgccagccgctgccgcccgccattgccgtggcggtggtggtggtggcggtgctcgtccatccacgagcggtggcggtggcgcaggctcagccttcgccgggctacttcccgagcgccacggtgaggtccatggccttctccgaggactacgacaacctgtgggggccgcagcaccagacgctgtcgcaggacaagatggcgctcacgctcttgatggaccgaacctcaggcagcggattcaagtcgaagcgctcgtaccggaacggctacttcggcgtctccatcaaggtgcagccgggctacaccgccggcgtcaacaccgccttctacctgtcgaacaacgagctgtaccctgggaagcacgacgagatcgacatagagctgctgggcacggtgccgggggagccctacactctgcagaccaacgtgtacgtgcggggcaccggcgacggcgcgcacctggtggggcgggagatgcggttccacctctggttcgacccgaccgccgacttccaccactacgccatcctgtggaaccccgacgagatcgtcttcctcgtcgacgacgtccccatcaggcgctacgccgccgccagcacgacgttattcccggacagggagatgtgggcgtacggctccatctgggacgcctccgactgggccaccgacggcggccgctacagggccgactaccgctaccagcccttcctggcgggcttccggacgttcaggaccgccggatgcgaggccgccgcgcccgccgccgggtgcccacccgtgccggcgtcccccgccggcgctgggctcagcgtgcagcagcgtgacgccatgcgctgggcgcagcagaggtccatggtctactactactgccaggattacacaaaggatcgctccttatacccagaatgctcgctcgctacctagctagctagcctgatgatgagtagtgattcattaattaagattattaagcaccctgccgtgcgtaactagtagtaattgaagcatgcatgatcgaagcagcagctcatagcagatcatatagcagagagcggcaagggaggaggcgtgcgattgaagcgccgccctacgtatacgtagtagtacactagtacgtacgtacggatcatcctaaaattgttcactggtggttgaggcgtgtgacttatttatcttcaattcagagatgcacactagtctggatccatatatatgtaatgtataaataagtccattatct

SEQ ID NO: 3223 - DNA, 1156 bp, Zea mays
tgcgaccgaagctagctagcagctcttcttgctttgcattaattattgcgagatgacgatgtccattgttgctgccgtgctgctgttgctgctcgtccatgtccatccacgggcggcagcggcgcaaccttcgccgggctacttcccgagctccacagtgaggcccatggccttctcggatggatacgacaacctgtgggggccgcagcaccagacgctgtcgcaggacaggatggcgctgacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtaccctgggaggcacgacgagatcgacatggagctgctgggcaccgtgccgggggagccctacacgctgcagaccaacgtgtacgtgcggggcaccggcgacggcgcgcgcctcgtggggcgggagatgcgcttccacctctggttcgacccggccgccgacttccaccactacgccatcctctggaaccccgaccagatcgtcttcctcgtcgacgacgtccccatcaggcgctacgccgccgccagtgcgccgttcttccccgaccgccagatgtgggcgtacggctccatctgggacgcctccgactgggccaccgacggaggccgctacagggccgactacagctaccagcccttcctggcaggattccgggggttcaggaccgccggatgcgaggccgccgcgcccgcccagtgccgtcccgtgccggcgtcccccgccggcgccggacttagcgtgcagcagcgggacgccatgcgctgggcgcagcagacctccatggtctactactactgccaggattacaccaaggatcgctccttgtacccagagtgctcgctcgctagctagcctagctagcactaccactaccagagcatgcatggaggaggcgtgcgagtgaagaagcgccgccctacgtacgtaccgttctaaaattgtatgtacaattaagtctccatccacatccatatatacaacatatgtaatgtataattaagtccattattaatttaatcatcaaaaatggaacatgcctatatatttcct

SEQ ID NO: 3224 - DNA, 1174 bp, Zea mays
gcattcagcgtgcgaccgaagctagctagcagttattcttgctttgcattaattattgcgagatcgatgacgatgtccattgttgctgccgtgctgctgttgctgctcgtcgtacatccacgggcggcagcgtcgcagccttctccgggctacttcccgagctccacggtgaggcccatggccttctcggatggatacgacaacctgtgggggccgcagcaccagacgctgtcgcaggacaggatggcgctcacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtacccggggaggcacgacgagatcgacatggagctgctgggcaccgtgccgggggagccctacacgctgcagaccaacgtgtacgtgcggggcaccggcgacggcgcgcgcctcgtgggccgggagatgcgcttccacctctggttcgacccggccgccgacttccaccactacgccatcctctggaaccccgaccagatcgtcttcctcgtcgacgacgtccccatcaggcgctacgccgccgccagtgcgccgttcttccccgaccgccagatgtgggcgtacggctccatctgggacgcctccgactgggccaccgacggcggccgctacagggccgactaccgctaccagcccttcctggcgggattccgggggttcaggaccgccggatgcgaggacgcccagtgccgtcccgtgccggcgtcccccgccggcgccggactcagcgtgcagcagcgggacgccatgcgctgggcgcagcagacctccatggtctactactactgccaggattacaccaaggatcgctccttgtacccagagtgctcgctcgctagctagcctagctaccactaccagagcaagagcatgcatggaggaggcgtgcgagtgaagaagcgccgccctacgtacgtaccgttctaaaattgtatgtacaattaagtctccatccacatccatatatacatatgtaatgtataattaagtccattattaatttaatcatcaaaaaatggaacatgcctatatatttcctacaaaaaaaaaaaaaaaa

SEQ ID NO: 3225 - DNA, 1251 bp, Sorghum bicolor
atgcacatcgcccaaacaaaccctcgctttcaccgcgccgcaatcccacctaactcccaacaggcgcaaatggcggcggtcggaacacttcccggcgccgccgcagtcgctggcgcttctgtgcgccaacgccaatgccgcggcgccgccccttctttcgtagccgcctacgtccgcgagggcacccgcctcgtctacgggaggcagctccgtccggctccggtcctcgcctgtccagcgaggcggcggttcctcggcgctgctgctgcagcagcctcctcaggttcagctggagatgcagagccccagggatttgcagagagatacccaacccttgtcacaggtttcttcttcttcttgtggtattttctgaatgtaatatttaacatcctcaacaagaagatcttcgactacttcccctatccatattttgtatcagtgagccatctttttattggagtactatactgcctcattggctggagcttcggtatcccaaagcgcgcgccaatcaactcaacacttctgaagcagcttcttccagttgcggtttgccatgccattggccatgtaacaagcactgtgtcatttgctgctgtagctgtgtcatttgcccacactattaaagctctcgagccattcttcaatgcggctgcttctcagtttatccttggacaaccagttccattgacactctggctatctcttgttccagtcgtggttggtgtctcggtagcatccctcactgaactctcgttcaattggactggcttcattaatgccatgatctcaaatatttctttcacctaccgaagcatctattcgaagaaggctatgactgacatggatagtaccaacttgtatgcatacatatcaataattgctctctttgtctgcattccccctgcacttattattgaaggacctcaattaatgcagcatggatttaaagatgcaattggcaaagttggattaacaaaattgatttctaacttttttgtggtgggcttattctatcacctttataaccaggttgctacaaacacattggagcgggtagcccctctatcacacgccatcggcaatgtgttgaaacgtgtatttgtcattggcttttccatcatcgtctttggcaacaagatcaccacacagactggaattggcacttccattgctatttctggtgttgctctctactcatttataaaggctaagattgaggaggagaaaaagcaaataaagagtgcataa

SEQ ID NO: 3226 - DNA, 1875 bp, Zea mays
ctcccaagtcccaactcccaacaggcctaaatggcggcggccggaacaattcccggcgccgccgcagccattggcgcttctgtgtcccaacgccaacgtcgcgtcggcgctccttctttcgtagctgcctacgtctccgagggcacccgcctcgtctgccggaggcagctccgtccggctccggtcctcgcttcttccttcatctccctttctcatccagcgaggcggcggttcctctgcgatgctgcggccggagcctcctcaggtcccgctggagaagccaagccccagggatttgcagagagatacccagctcttgtcacaggtttcttcttcttcttgtggtattttctgaatgtaatatttaacatcctcaacaagaagatcttcgactacttcccctatccatattttgtgtcagtgagccatctttttattggagtactatactgccttattggctggagcttcggcatcccaaagcgcgcgccaatcaactcaacacttctgaagcagcttgttccagttgcggtttgccatgccattggccatgtaacaagcactgtgtcatttgctgctgtagctgtgtcatttgcccacactattaaagctctcgagccattcttcaatgcggctgcttcccagtttatccttggacaaccagttccattgacactctggctgtctcttgttccagtggtgattggtgtctcggtagcatccctcactgaactctcatttaattggactggcttcattaatgccatgatctcaaatatttctttcacctaccgaagcatctattctaagaaggctatgactgacatggatagtaccaacttgtatgcatacatatcaataattgctctctttgtctgcatcccccctgcaattattattgaaggacctcaattagtgcagcatggttttaaagatgcaattgccaaagttggattaacaaagttgatttctaatttttttgtggtgggcttattctatcacctttataaccaggttgctacaaacacattggagcgggtagcccctttaacacatgccatcggcaatgtgttgaaacgtgttttcgtcattggcttttccatcatcgcattcggcaacaagatcaccacacagactggaattggcacttccattgctgtttctggtgttgccctctactcatttataaaggctaagattgaggagaaaaagcaaataaagagtgcataaggtgttggctgatgtggatgcggttggtttgtcgctttgatggacctctattctctcggtgaacgaacaaacttgcaagatggataaaatcttgctatctcctagtacatttgattgttattcccagtctggtactgaggtgtgcggttgttgttggctaacttgtttatttgaagcaaatttgagcaatgctcagtggcatggaatttccatttctgttttccttcgctcatttattctgacttgacatggtgctattgtaatcttaagcagtagtgtctctagaatgttttccccaaggagatttcagtaccaaatttgaacaatcctcaaactagaaattttgatttccatgcaccccactcagcaattctgacatacaatggtgttcatgtaatcttaagcagtagtgtctcctgatctttccaaggagattttcagtatcgttgatagtacattacgataaaaagcaaaatgcagtgagagcaatgttgccaatcgtgtgatataacctatttgtactaaggtatcattgttgacaggagcaaattaattgtaccaggttgcaaacatgtagcatgcagtttaaatgttacacttatgacatgggtcacatgtgtagatagacaggctaaggtggaattt

SEQ ID NO: 3227 - DNA, 1671 bp, Zea mays
actgttcaaacaaaccctccactgccctccccactctccccttcaccgcgccgcactcccaagtcccaacaggcctaaatggcggcggccggaacaattcccggcgccgccgcagccattggcgcttctgtgtcccaacgccaacgtcgcgtcggcgctccttctttcgtagctgcctacgtctccgagggcacccgcctcgtctgccggaggcagctccgtccggctccggtcctcgcttcttccttcatctccctttctcatccagcgaggcggcggttcctctgcgatgctgcggccggagcctcctcaggtcccgctggagaagccaagccccagggatttgcagagagatacccagctcttgtcacaggtttcttcttcttcttgtggtattttctgaatgtaatatttaacatcctcaacaagaagatcttcgactacttcccctatccatattttgtgtcagtgagccatctttttattggagtactatacttccttattggctggagcttcggcatcccaaagcgcgcgccaatcaactcaacacttctgaagcagcttgttccagttgcggtttgccatgccattggccatgtaacaagcactgtgtcatttgctgctgtagctgtgtcatttgcccacactattaaagctctcgagccattcttcaatgcggctgcttcccagtttatccttggacaaccagttccattgacactctggctgtctcttgttccagtggtgattggtgtctcggtagcatccctcactgaactctcatttaattggactggcttcattaatgccatgatctcaaatatttctttcacctaccgaagcatctattctaagaaggctatgactgacatggatagtaccaacttgtatgcatacatatcaataattgctctctttgtctgcatcccccctgcaattattattgaaggacctcaattagtgcagcatggttttaaagatgcaattgccaaagttggattaacaaagttgatttctaatttttttgtggtgggcttattctatcacctttataaccaggttgctacaaacacattggagcgggtagcccctttaacacatgccatcggcaatgtgttgaaacgtgttttcgtcattggcttttccatcatcgcattcggcaacaagatcaccacacagactggaattggcacttccattgctgtttctggtgttgccctctactcatttataaaggctaagattgaggagaaaaagcaaataaagagtgcataaggtgttggctgatgtggatgcggttggtttgtcgctttgatggacctctattctctcggtgaacgaacaaacttgcaagatggataaaatcttgctatctcctagtacatttgattgttattcccagtctggtactgaggtgtgcggttgttgttggctaacttgtttatttgaagcaaatttgagcaatgctcagtggcatggaatttccatttctgttttccttcgctcatttattctgacttgacatggtgctattgtaatcttaagcagtagtgtctctagaatgttttccccaaggagatttcagtaccaaatttgaacaatcctcaaactagaaattttgatttccatgcaccccactcagcaattctgacaaaaaaaaaaaaaaaa

SEQ ID NO: 3228 - DNA, 1464 bp, Oryza sativa Japonica Group
aaaaatggcggcggccagggccctcctgcccgtcggcggcgccgccgccgtcgccgttcctcgacggctgcgctccggggaagcctcgtcgacgtcgctcagcggccccgtatcggatggcgcccgcctcgtccgccggatgcagctccgccctgctcccctcctcggttcgtcaacttgcgcgctgccttccctgcggggtaagcggctcatccgcaccccggctgcttcctcctcctcctcctcgttggactccaccggggaagcaaagcctgtgggatttgcagagagataccctgctcttgtcaccggtttctttttcttcatgtggtattttctgaacgtgatatttaacatccttaacaagaagatcttcgactacttcccctatccatattttgtgtcggtgagccatcttttggtaggagtcttgtactgccttgtcggctggagttttggtctcccaaagcgcgcgccgatcaactcaacggttctgaagctactgttcccagttgctgtctgccatgctattggtcatgtaacaagcaccgtgtcctttgctgctgtagctgtctcatttgcccacaccattaaagctcttgaaccatttttcaatgcggctgcttcacagtttatccttggccagcaagttccattgacgctgtggttatctcttgctccggttgtgataggtgtttcaatggcatctctcactgaactttcattcaattggactggtttcgttaatgccatgatttctaatatctccttcacattacggagcgtttattccaagaaggctatgactgacatggatagcaccaacctgtatgcgtacatctcaataattgctctccttgtctgcatccctcctgcaattattattgaaggacctcaactagtgcagcatggattcaaagatgctattgctaaagttggattagcaaagttggtttctaatctccttgtggtgggcttgttctatcacctttataaccaggttgctacaaacacattagaaagggtgacccctctaacacatgctgttggcaatgtgttaaaacgtgtcttcgtcattggcttctcaatcattgcattcggcaacaagatcaccacacaaacaggaattggcacttgcattgccatagctggtgttgcactctattcttatatcaaggctaagattgaagaagagaaaacgcaaatgaagagcgcataaggagttgaatctgtggatatagttgggtagctgctttgatcgatctgtattgcctccgagaaataaaatgagctgtaagatttataacaatctaggtgcctgctgtatctcatcttgtttgttattgtcgatttcgctttgaacagcaaaagctaccgatgcattttttttttttttgtaaattataactgctaaaaacccgcagaaacaaagcctccatcatcccattttccccttccttggct

SEQ ID NO: 3229 - DNA, 1715 bp, Hordeum vulgare subsp. vulgare
gaacatcctcacactgacgccttcgcggtagacagacacaaatggcggcggtcgccaccatcctctgcggcggcggcgccgccgtcgccggccaccagcggttccgccgccgcggagccccatcgctccatgccagaggcaaccccgtctcggacggcgctcacctggtctgcggtgggaagctccgaccggcgttgttccccgcttcctccttcggtaccgtatccctgccttctccggggagtaggaggctcccccggacgtcggcttccggtccctcatctgactcccaggggcaagcaaagcccatcggttttttggagaggtacccggctcttgtcactggtttcttcttcttcatgtggtattttttgaatgtgatatttaacatcctcaacaagaagatctttgattacttcccctatccatactttgtgtcggtgacccatctttcggttggagtcttgtactgccttatcagctggggcaccggtctcctgaagcgtgcgccgatgaattcgacgcttttgaagctgctgctgccagttgcaatttgtcatgccatcggtcatgtaacgagcactgtgtcttttgctgccgtatcggtctcatttgcccacaccattaaagctctcgagccgttcttcaacgcggctgcttcacagtttattcttgggcagcaagttcccttcacattgtggttatccctggctccagttgtgataggtgtatcaatcgcatctctcaccgaactctcattcaactggactggtttcatcaatgccatgatttctaatatctcattcacctaccgtagcatttattcgaagaaagctatgactgacatggatagcaccaatctgtatgcctatatctccataattgctctcatcgtctgcattcctccagcacttattattgaaggacctcaactagtgcagcatggatttaaagatgcaattgccaaagttggattaacaaagttagtttccaatattttcttggcgggcttgttctatcacctttataaccaggttgcaacaaacacattgcagcgggtggcccctctaacacatgccgtcggcaacgtgttgaaacgtgtctttgtcatcggcttctcaatcatcatttttggcaacaagatcacgacacaaactggaattggaacagccattgctatttctggtgttgctctatactcagttatcaaggctaagattgaggaggagaaaaaggaaggcgtgccggcggtagctccttgaagatggaataaggtcctccctgcctagcccctggccgtcggtgcatgtagcatctatcatcgtcgaagggcgtgtcgaggtgtgtctccggcggatctcgtgggattcactcggttcggtattggtctttgctggatctccaattttcgttcgtgtgtttacaacaggttgaatcctttagatctatgattctcttcatcgtcgacagttgttgttctggtgcactggtcgtgtggggcattagtatgatgacttccgactgtttagttttgctcggcacggtgagggagggacgatgccggcagtgcacctttggctcgctcaagtgctttagtcatcgctaggtgatctacgaacctaagtgtattttttttctagtgttctttgcactgtcatgacagataatgcatagaccagaagttttctttataagatcttagggtaatttaagcc

SEQ ID NO: 3230 - DNA, 1049 bp, Zea mays
gaccctaaccaagctgatgtacactctcatacaatcagaaatctgtacaaagccagcagtccgtagttagcagcagcatgcatgacctcgatcgccaatccgtacttatgcacacgagcatttcccacgaggccacgaccttcgcccgctcgatcgcgcgcgcgcgctcgaggggacgggcatcatctcccttcggcgtcgcgctgcaggagcctgatcacctcgtcgggcgggacgtcgcgccacacccggggccgcgcggcgccgtggccgagcttggcgaagccgtgcgccacccggttacccccgcgccgcacgtgcgagacgctcatgtcgtcgagcagcagcagcagcttctcgatctccccgaacaggcgcaggtcctccggggcccgtacccgcacgcgcgcgcggctccgcacggcgtcgaccaccgccatggcgtcgccctcgacccagacgctgcgccagccgttggccaccgcgagctccagcccgcgccggagcgccgcgagctccgccacggagctggtcgcggcgccgatccgctccgcgtagcccagcacgaacccgccctcgtggtcgcggtacacgccgccgatgctcgcgcgccgggacgcgtgcctcgacgacccgtcgaagttgagcttcagtcgcccgggctccggcttcctccacgtgctcgccgacggctccggtcgcgacggcccgttgttatcacccccgcgcagcccccggcgcccgcccggcgccgcccttccgccgccgacgaggcaggccgacaaagggtggcacagcagcatgctgccagtgacaagaggacggtgcacccgcagcatcgttccccggcgtcaaactgctgcgcggcgaactttgatgcgcatttagcgcccgtgcacgcactttgcttgaagcgatcgctcgcctgagggcgaggcgtgcaggacagatcgactgatggaggatgatgagatgacagggaaccaagaactcaagatgttgtttgaaatggcatggttgctggagctggagctgagcatatgccgttg

SEQ ID NO: 3231 - DNA, 1798 bp, Sorghum bicolor; identical to SEQ ID NO: 558

SEQ ID NO: 3232 - DNA, 1817 bp, Zea mays; identical to SEQ ID NO: 559

SEQ ID NO: 3233 - DNA, 1798 bp, Zea mays; identical to SEQ ID NO: 560

SEQ ID NO: 3234 - DNA, 1758 bp, Hordeum vulgare subsp. vulgare; identical to SEQ ID NO: 561

SEQ ID NO: 3235 - DNA, 4126 bp, Oryza sativa Indica Group; identical to SEQ ID NO: 562

SEQ ID NO: 3236 - DNA, 1900 bp, Zea mays
gcgcactcgcataaaaaaatgttcgccacctttctcctgctgctgtggtcccatgccccggcgccggcgctctcgctgccgccgcgccctccggtacgctgcagcgatggcgggaccacgggctgcgtgctctccaacgcctacggcgcgtggtcgagcgaccgcgccgactgccccgtctcctccgtcgcgtacccggcgtccgagcaggaggtggtcgcggccgtggcgcgcgccagcgccagcggcgcccgcgtcaaggtcgtgagcggcttcgcgcacaccattccgaagctcgcctgccccggcggcggcaacggcactaccaccaccctgctcatcagcctcacggcggcgccgtactgggagggcgtcagcgtcgcggggctcgtgagcacagggtcccacggcagctcgtggtggggccgcggcggtgccgtgcacgaccacgttgtggggctcaggctcgtcgttaccgccggggaggctgacggctgggccagggtcctgacgctgcgcagaggcgacgagctcttcccggctgcgcttgtctcgctcgggctgcttggggtcgtctccaagatcacgctgtcactggaaccgaggttcaagcgcagcatcaccttcgactacaggaacgattccaccttccaggacgacttcgccgctcacgcggcgagccacgagttcgccgacatcacctggtacccgtcccagcacacggccgtgtaccgcatcgacgaccgcgcgccggccaacgcgcctggggacggcgtcaacgacttcatcggcttccaggcgacgcccatcgctgtcaccgccgggctcagagtggtagaaacttcactggagcggtccaagaacatgaagggcaagtgtgcgatggcggcggcggagggcgtggcgaagcggctggtcggcaacgggctgaagaacaacggcctgctgttcacggggtaccccgtggtggggtaccaggggaagatgcagacgtcgggctcctgcgcgcgctcctcggcggcggacctgctcagcgcgtgcgggtgggatcccaggttccacggcctcttcttctacgagagcacggcgatcttctcgccggcccggttccgggacttcatcctcgacgtgaagcgcctgcgggacctcgccggctcggacagcctctgcggcgtcgacgtgtacaacggcctcctggtccggttcgtgaaggcgtccgcggcgcacctcggccagccggaggactccgtcgtggtggacttcaactattaccgcgcgtcggactcggcggcgccgcggctgagccaggacgtgtgggaggaggtggagcagctggcgttcgtcaagcacggcgccaggccacactgggccaagaaccgtttggtggcgttcgccggcgtgcggggcaagtacccgcggtggggccagtttgcggcggctaagcggcagctggacccccggggcttgttcgacagcccgtggtcggacgaggtcgtcggcggggtggagctggccaagggcgacgggtgcgcgctggacggccggtgcgtgtgctccgaggacaggcactgcagccccgagcaggggtactactgcaggccggggctcgtgtttacggacgccagggtctgcaggtactcggggtcgcagaaccagtgagtcaccatatttctctgtggattggtttcgagcttgactgaaagctgtgagccgtgtggataatagatttcacatttaaagagtgcttgtagctatacgttagggtcataatacaaaaaggagaagaatttctgtaatattggcattctagaaattaaatcagtgacaatgaagaagttacatgtatcaaatatccttataaaggaagggaatcctaagaatatatgatttaaaatgctac

SEQ ID NO: 3237 - DNA, 1752 bp, Sorghum bicolor
atgctcgccacctttctcctcctgctgctgtcttcccatgccccggcgccggtgctctcgctgccgccgcgcccgccggtgcgctgcaccagcaccggctgcgtgctctccaacgcctacggcgcgtggtccagcgaccgcgccgactgccccgtgtccgccgtcgcgtacccggcgaccgagcaggaggtggtcgccgccgtggcgcgcgccagcgccaccggcgcccgcgtcaaggtcgtcagcggcttcgcccacaccatcccgaagctcgcctgccccggcggcgggaccgggaacggcaccacgctgctcatcagcacggcgaggctggcgggcgtggaggaggtggacgtggcggcgcggacggtgaccgcggacgccggcgcgccgctgcgggccgtcatcgacgcggccgaggcgcgcgggctcagcctcgcggcggcgccctactgggagggcgttagcgtcgcggggctcgtcagtaccgggtcccatggcagctcgtggtggggccgcggcggtgccgtgcacgaccacgttgtgggcctcaggctcgtcgtggccgccggggaagctgacggctgggccagggtcgtcacgctgcgcgcaggcgacgagctcttcccggctgcgctcgtctccctcggtctgcttggggtcatcaccaagatcacgctgtcactggagccgaggttcaaacgcagcatcacctacgactacagggacgactccaccttccaggacgacttcgccgcccacgcggcgagccacgagttcgccgacatcacctggtacccgtcccagcacacggccgtgtaccgcatcgacgaccgcttgccgctcgacgcgccgggcgacggcgtcaacgacttcatcggcttccaggcgacgcccatcgccgtcacggccgggctcagggcggtcgagacctcgctggagcggtccaagaacgtgaggggcaagtgcgtgacggcgaaggcggagggcgcggcgaagcggctggtcggcagcgggctgaagaacgacggcgtgctgttcacggggtaccccgtggttgggtaccaggggaagatgcagacgtcgggctcctgcgcgcgctcgtcggcggcggacctgctcagcgcgtgcgggtgggatccgaggttccacggcctcttcttctacgagagcacggcgatcttctcgccgccggcgcggttccgggacttcatcctggacgtgaagcgcctccgggacctcgccggctccgacagcctctgcggcgtggacgtgtacaacggcctcctggtccggttcgtgaaggcgtcggcggcgcacctgggccagcccgaggattccgtggtggtggacttcaactactaccgcgcgtcggacccggcggcgccgcggctgagcgaggacgtgtgggaggaggtggagcagctggcgttcgtgaagcacggcgccaggccgcactgggccaagaaccgcctggtggcgttcgccggcgtgcgcgggaagtacccgcggtgggcgcagttcgcggcggcgaagcgggagctggacccccggggccttttcgacagcccgtggtcggacgaggtcgtcggcgcggtggaggtagccaagggcgacgggtgcgcgctggacggccggtgcgtgtgctccgaggacaggcactgcagccccgggcaggggtactactgcaggccgggcctcgtgtttacggacgccagggtctgcaggtactcggtgtcgcagagccagtga

SEQ ID NO: 3238 - DNA, 2271 bp, Hordeum vulgare subsp. vulgare
ggggctagccaaggcaacgcgcactcgcactcgcacgcacggcccggagaagagcaaacacaacgatggccgcttttctcctgctcgtgctctgctcgctggccccgggcgccctctccgtcccgccccgcccgccggtgcgctgcggcgacgcgggctgcgtgctctcgaacgcgtacggcgcctggtcgagcgaccgcgccgactgccccgtgtcggccgtggcgtacccggcgtccgagcgggacgtggtcgcggccgtcgcgcgcgccagcgcgggcggcatgcgggtcaaggccgtcagcggcttcgcgcacaccatcccgaagctggcctgccccgggggcggcggcggcgggaacggcagcgcggcgtctctgctgatcagcacggcgaggtacgccggcgtggaggtggacgcggcggcgcggacggtgaccgcggacgccggcgccccgctgcgggccgtgattgacgcggcggaggcgagcgggctgagcctgccggcgtcgccgtactgggagggggtgagcgtcggcggggccgtgagcaccgggtcccacggcagctcgtggtggggccggggcggcgccctgcacgaccacgtcgtggggctcagccttgtcgtgcccgccggagcggccgatgggtgggccaaggtggtgccgctcgccagaggtgacgcgctctttcccgccgcgctcgtctcgcttggcctgctcggagtcatatccaaggtcactttggcgctggagccaagattcaagagaagcgtgacctacgattacagggacgactccaccttccaggacgacttcgcggaccacgccgcgcggcacgagttcgccgacatcgcctggtacccgtcccagcaccaggccgtctacaggctcgacgaccgcgcgccgctcaacgccaccggcgacggggtcaacgacttcatcggcttccggtcgacgctcatcgcggtctcccagggggtcagggcgctagagaccgcactggaagggtcgaggaacgtcaagggcaagtgcgcgatggccgcggcggagattgccgccaagcggctgatcggcaacgggctgcgcaggaaggccggccagctgttcaccggctaccccgtcgtggggttccaggggcagatgcagacgtcgggctcctgcgcgcggtcgccggcctccagcccgctcacggcgtgcgcgtgggaccccaggttcaagggtctcttcttctacgagagcacggccatcttctcgccggcgcggttccggtccttcgtgctcgacgtgaagcggctgcgcgacctcagcccggacagcatgtgcggcgtggacgtgtacaacggcctcctggtccggttcgtgaggaggtcggaggcctggctggggcagccggaggactccgtggtggtggacttcaactactaccgcgcggcggacccgtcggcggcgcggctcagccaggacgtgtgggaggaggtggagcagatggcgttcgtcaagcacggggcgcggccgcactgggccaagaacaggatggtggccttccggggggtgcaggggaagtatccgggatgggccaggttcgccgcggccaagcggcagctggatccgcggggactgttcgacagcccgtggtccgacgacgtcgtcggcggcaaggagctcggtaaggaggatgggtgcgcgctggacgggggatgcgtctgctcggaggacagacactgcagcccggagcaaggatactactgcagaacggggcttgtgtttacagaggccagggtatgcagatactctgcctcgcagcttgtataggacatatacacccttctgttgtataaaacagagacagtaccatatacgtatatcacttatgttctacagttttttttccgccttaactatatgtaagttgtctgaattctcccctcaaaaaaaggttgtctgaatttttcaatttgggttattggctgttgattctgctacgaggtttgtgctgtgttttttcttttatgatgtctgttgcactcgatcacctatggagtcattggccctttcgtggttcggccggaagatggcgctgtacaaagagaagaaatttcgaggcaggacgatgatgggacccgaggatcatatatatcacttctgctctatactttatttttttccaccttaactatatgtaagttgtctgaatttttcaatttgggtcattggctgttgattctgctacgaggtttgtgctgtgtttttctttcatggatgttgttct

SEQ ID NO: 3239 - DNA, 1779 bp, Oryza sativa Japonica Group
atggtcgccacctttctcctccccctcctactctccaccctgctgcccgccgccgtcccgctgccgccgcgcccgcctgtgcggtgtggcggtagcggcggcgccggcggcgatggggcaggctgcgtgctctccaacgcctacggcgcgtggtcgagtgaccgcgccgactgccccgtctcggccgtcgcgtacccggcgtccgaggctgacgtggtcgcggtcgtcgccgacgccagcgccaagaacatgcccgtcaaggtcgtcagcggcttcgcgcacaccatcccgaaactggcgtgccccgggaacggcagcagcggcgcggcctcctccttgctcatcagcacggcgaggtacgacggcgtggcggtcgacgccgccgcgcggacggtgaccgcggacgccggcgcgccgctgcgggccgtgatcgacgcggcggaggcgagcgggctgagcctgacggcggcgccgtactgggaaggggtgagcgtcggggggctcgtcagcacgggctcccacgggagctcctggtggggccgcggcggcgccgtgcacgaccacgtggtggcgctcaggctcgtcgtgcccgccggcgcggcggacgggtgggccaaggtggtggcgctccggagaggcgacgcgctcttcaacgccgctctcgtctccctcggcttgctaggggttatctcaaaggtgactctggctctggagccaaggttcaagagaagcataagctacgagtacagggacgactccaccttccaggacgacttcgcacgccacgccgcgaaccacgagttcgccgacatcacctggtacccgtcgcagcacaaggcggtatacaggatcgacgaccgcatgccgctcaacgccacgggcgacggcgtcaacgacttcatcggcttccagtccacgctcatcgccgtctcctccggcatcagggccctcgagaccgcgctggaggcgtccaggaacgtgaagggcaagtgcaagatggcggcggcggagatcgcggcgaagaggctcgtcggcaacgggctgcgcggcgccggcgggcggctgttcacgggctaccccgtggtggggttccaggggaggatgcagacgtcgggctcctgcgcgcgctcgccgcccaccgacacgctcagcgcgtgcccctgggaccccaggtacaagggcctcttcttctacgagagcacggcgatgttctcgcctgcggcgaggttccgcgacttcgtcctcgacgtcaagcggctgcgcgacgtcgacccggacagcatgtgcggcgtcgacgcgtacaacggcctcctcgtcagattcgtgaaggcgtcggaggcatacctgggccagccggaggacaccgtggtggtggacttcaactactaccgcgcgtcggacgggtcgtcgccgcggctgagccaggacgtgtgggaggaggtggagcagctggcgttcgtcaagcacggggcgcgcccgcactgggccaagaacaggctggcggcgttccggggcgtgcggggcaagtacccgagctgggacaagttcggcgcggcgaagcggcagctcgacccgcgggggctgttcgacagccggtggtccgacgaggtcgtcggcggggaggagcagctgcccaaggccgacggctgcgcgctggagggccgctgcgtctgctccgaggacaggcactgcagcccgagcaaggggtactactgcagaccggggctcgtttattcagaggccagggtctgcaggtactccgtttcgcaactagtctaa

SEQ ID NO: 3240 - DNA, 2741 bp, Sorghum bicolor
atgaagggggcaatgccgccgcggccgttcatgatgccgggcccggggggcccgatgccgcccccgcagcagcagttcgggctggtggagacgcggcccccgctggcggccgtgctgcgtccgcgcttcaacatcccaggcctccacccctcggccgccgccgccgccgcggccacgggcgcgggcaagatcgcctccacctacgacctcgtcgagccgatgcggttcctctacgtgcacgtcgtcaaggcgcgggacctccccgcggtgtccgccacgggcgccatcgaccctttcgtcgaggtcaagctcggcaacttcaagggcaccacggccgtcaaggcggccagccacaacccgtcctggcagcaggtcttcgccttctccgccacgcacctccagtcccatctgctcgaggtcgcgctcaaggccaaggatctcgccggcgacgacctcgtcggacgcgtcgtcttcgacctcgccgaggtgcccgtccgcgtgcccccggactcgccgctcgcgccgcagtggtaccgcctcgaggccaagcgcggcgacaagctgccccatggggagatcatgctctccgtctggctcggcacccaggccgacgaggcgttcccggacgcctggcactccgacgcgcacgccgccgcgggacccgcggccgtcgcgtccacgcgcgccaaggtatacttctcgcccaagctcgtgtacctccgcgtcgcggccatcggcgcccaggacctcatcccgcacgacacctcgcgcccgatgagcgcctgcgtcaagctgcagctcgctggccaggtgcgccgcacgcgccccggcgcgccgccggggacgcccaacccgatttggaacgaggagttcatgttcgtcgcctcggagcccttcgacgagccgctcgtcgtcaccgtcgaggaccgcgtcgcgcctggccgcgacgagatgctcggccgcattgtgctgcccctcgcggcagcaatgccgcggcacgaccacttcggcaagcccgtggagccacggtggtacagcctcatgcgcccctccgatgatcctgacaagaaggaaatcaagttcgcaagcaagatacagattcggatgtcccttgattttgggtatcatgttcttgacgagtccacctactacagcagtgatctgcagccatcatcaaagcctgcaaggaaaccaagcattgggatgcttgagctgggagttctgggtgcgcggaacttgataccgatgaagcccaaggatggacgcaccacagatgcctattgtgtggccaaatatggaccgaagtgggtgcgcaccaggactattcttgacacgctgaatccacaatggaatgagcagtatacttgggaggtgtttgatccttgcaccgttatcacggtggtggtgtttgacaatggccaaattgggaagaatggtggaggcccagatcagcggattggaaaggtcaggatccggctctctacactggagactgacagagtgtacacacatttctaccctttgctggttttacatccaagtggactcaagaagactggcgagcttcatttggctgtgcggtttacctgcacagcttgggtgaacatgatggcgctgtatggtcgtccgctgcttccgaagatgcactacacacagccgatcgcagtgatgcaattggactacctgaggcaccaggcaatgcagattgttgcagcaagactcagccgtgctgagcccccgctgcgcagggagattgtggaatacatgctcgatgtggactcacatatgtttagtctccggcgcagcaaggctaattttcatcggattacctcactgttctttggttttctggcaatgctcaagtggtatgatggcatcagaagctggcggaacccaatcacaacaatgctagtacacatgctgttcctgatactgatctgctacccggagctcatcctgcctactgtcttcctctacatgttcatgattgggctgtggaactatcggtacaggccaaggcatccgtcgcacatggatactaagctgtcccatgctgagctgacacaccctgatgagcttgatgaggagtttgacacattcccttcctcaagaccagctgagattgtaaggatgcgctacgacaggctgaggagcgtcggaggccgtgtgcagactgtggttggggacctggcaacacaaggcgagagagcccatgctttgctgagctggagggaccctcgggccaccgccatcttcattttcttatccctggtggtcgccattgtgctgtacgtgacgccgttccaggttttgatggtgataggcatgctctacctgctgcgacatccccggttccgcagcaggatgccctccgtgcctttcaacttctacaggagactgcctgccaagtctgatatgcttctttgagattcagcgtaagagagacatgtgcaagtcatgcttatttatgtctgttccgctcggttccttctggttagcatcagatcagatgtgaatatacctgatgagttcatatattagaggtcattagtgtcccagcaataaggtgtcggtttaatggtttatttgcttggttatgccaaagaaagggaaccactggatcccttttgagttttgggatagtgacaggaggtttttgggtgcagaaatgtaatgttaacttcaggttattagcttatagaactaaaggcaggaacaatgttatcccccgtgtattatgt

SEQ ID NO: 3241 - DNA, 2886 bp, Zea mays
acagcactgttcggtggaatgcctcactagtcactcactactcactagtagggctcctgctgcctccaggtccagcccacgctaccccacaccgccgttcctccactgagcaaaccccgccgccgacgagatgaagggagcaatgccgccgcgccagttcatggtgccgggccctggggggccgatgctgccaccgcagcagcagttcgggctggtggagacgcgccccccgctggcggccgtgctgcggccgcgcttcaacatcccgggcctccacccgtcagcggcggccgccgccgcggcctcgggcgcgggcaagatcgcctccacctatgacctcgtcgagccgatgcggttcctctacgtgcacgtcgtcaaggcgcgagacctccccgcggtgtccgccacgggcgccatcgaccccttcgtcgaggtcaagctcggcaacttcaagggcaccacgcccgtcagggcggccagccacaacccgtcctggcagcaggtcttcgccttctctgccacgcacctccagtcccatctgctcgaggttgccctcaaggccaaggatctcgccggcgacgacctcgtcggccgcgtcgccttcgacatcgcggaggtgccggtccgcgtgcccccggactcgccgctcgcgccgcagtggtaccgcctcgagaccaagcgcggcgagaagctgccgcacggcgagatcatgctctccgtctggctcgggacccaggccgacgaggcgttcccggacgcctggcactccgacgcgcacgccgccgcgggcccggcggccgtcgcgtccacgcgcgccaaggtatacttctcgcccaagctcgtctacctccgagtcgcggccatcgccgcgcaggacctcatcccgcatgacacctcgcgcccgatgagcgcctgcgtcaagctgcagctcgccggccagctccgccgcacgcgccccggcgcaccgccggggacgcccaacccgatttggaacgaggagttcatgttcgtcgcgtcggagcccttcgacgagccgctcgtcgtcaccgtcgaggaccgtgtcgcgccaggccgcgacgagatgctaggtcgcattttcctgcccctcgcagcagcaatgccgcggcacgaccacttcggcaaacccgtggagccgcggtggtacagcctcatgcgcccctctgatgaccctgataagaaggaagtcaagttcgcaagcaagatacagattcggatgtcgcttgattttgggtaccatgtccttgacgagtccacctactacagcagtgatctgcagccatcatcaaaacctgcaaggaaaccaagcattgggatgcttgagctgggagttctgggtgcgcgaaacttggtaccgatgaagcccaaggagggacgcaccacggacgcctactgtgtggccaaatatggaccaaagtgggtgcgcaccaggactattcttgacacgctgaatccgcaatggaatgagcagtatacctgggaggtgtttgatccttgcaccgtgatcacagtggtggtgtttgacaatggtcaaattgggaccaagaatggcggtggcccagatcagcggattgggaaggtcaggatccggctctcaacactggagacggacagagtgtacacacatttctaccctctgctggttttaaatccgagtggactcaagaagaccggcgagcttcatttggctgtgcggtttacctgcacagcttgggtgaacatgatggcgctgtatggtcgtccgctgcttccgaagatgcactacacgcagccgatcgctgtgatgcaactggactacctgaggcaccaggcaatgcagattgttgcagccagactcagccgcgctgagccgccgctgcgcagggaggttgtggaatacatgctcgatgtggattcgcatatgtttagtctccggcgcagcaaggctaatttccatcgtatcacctcactgttctttggttttctggcaatgctcaagtggtacgacggcatcaggagctggtggaactcgatcacgacgatgctagtgcacgtgctgttcctgatactgatctgctacccggagctcatcctgcctaccatcttcctctacatgttcatgatcgggctctggaactatcgtttcaggccaaggcatccgtcgcacatggacactaagctgtcccatgctgagctgacacaccctgatgagcttgacgaggagttcgacacattcccttcctccagaccagctgaaatcgtaaggatgcgctacgacaggctgaggagcgtcggaggccgtgtgcagaccgtggttggggacctggcgacgcaaggcgagagagcccatgctttgctgagctggagggaccctcgggcctccgccatcttcgttttcttgtccctggtggtcgccgttgttctgtacgtgacgccgttccaggttctgatggtgataggcatgctttacctgcttcgacatccccggttccgcagcaggatgccctccgtgcctttcaacttctacagaagactgcctgccaagtccgatatgctcctttgagaccacagtatttggcgtgagagaatcgggtgcaagtctttacttatttatgtctgttctgctcggttccttctgattagtatcagatcagatgtgaatataccggatgagttcgtatattacgtcatttagtgtcccaggattccaggaataaggtgttggtttaatggttcatttccttttgagtttttgggatagtgaggggaggtttttgggtgcagaaatgtaatgttaactccgggctattagcatagaactaaaggcaggaacaatattatcccccgtgtattatgtttgtactatttgtgccaaaaaaaaaaaaaaaa

SEQ ID NO: 3242 - DNA, 2980 bp, Hordeum vulgare subsp. vulgare
gagacacacgctctcctccattgcgctaccacggcaccaaccaactgctcgacggtatgccaccacactaggccactcaccccacccccaccccactcccccccctccccctacccgcagagcgccgccgccgcagccgccgagatgagggggcaaatgcagccgcggccgttcatgatgcacggcggcccgatgccgccgccgcagcagcagttcgggctgacggagacgcgcccgccgctggccgccatgctgcggccccgcttcaacatcccggggctcaacccctccgccgccgccgccaatgccgcgggcaagatctcctccacctacgacctcgtcgagcccatgcgcttcctctacgtgcacgtcgtcaaggcgcgggacctccccggcgtgtcccccaccggctccatcgaccccttcgtcgaggtcaagctcggcaacttcaagggcagcaccgccgtcctgcccggcaaccacaccccttcctggcaccaggtcttcgccttctccgccacgcacctccagtcgcatctgctcgaggtcgccctcaaggccaaggatctcgccggcggcgacgacctcgtcggccgcatggtgttcgacctctccgaggtgccggtccgcgtgccgccggactccccgcttgcgccgcagtggtacaggctcgacggcaagcgcggggagaagctccagcgcggggagatcatgctgtccgtctggctagggacccaggccgacgaggccttcccggaggcctggcattccgatgcccatggggcggctagtccgtcggccgtcgcctccacgcgcgccaaggtctacttctcgcccaagctcgtgtacctccgcgtcgccgccatcggggcgcaggacctcgtgccccacgacacgtcccgccccatgaacgcctccgtcaagctgcagctcgccgggcaggtgcgccgcacgcgcccgggcgcaccgcctgggacgcccaacccgatgtggaacgaggagttcatgtttgtggcgtccgagccgttcgacgagcccctgctcgtcaccgtggaagaccgcgtcgggccaggccgcgacgagccgctcggccgcattatgctgcccctcaacgctgcaatgccgcgccatgaccacttcggcaagcccgtggagccgcgctggtacagccttgcgcgtcccagcgacgacggtgagaagaaggaaggcaagttcgcgagcaagatacagcttcggatgtcgctcgactttgggtaccatgttcttgacgagtcgacttactacagcagcgatctccagccatcgtcaaagcacacacggaagccgagcattgggatccttgaggtggggattctgggtgcgcgcaacctgatacccatgaaggccaaggatggtcgcaccaccgatgcttactgtgttgccaagtatggtcccaaatgggtgcgcacaagaaccattctcaacacactgaatccgcagtggaatgagcagtatacctgggaggtgtttgatccatgcaccgtgatcacagtggtggtgttcgacaatacacagattgggagcaagaacggtgatgcccgggatgaaagcattggcaaggtcagaattcgtctctcgacgctggagactgaccgggtgtacacccatttctaccctttgctagctctcaagccaagcggtctgaagaagaccggtgagctgcatttggctgtgcggtttacgtgcaccgcgtgggtgaacatgatggcaatgtatggccgtcccctgctgccgaagatgcactactcacaaccaatatcagtgatgcagttggactacctgaggcaccaggcgatgcagattgtttcggcgaggctgagccgtgccgagcctcctctccgcagggaggttgtggagtacacgctcgatgtgggctcacacatgtttagtctccggcgcagcaaggccaacttctatcgcatcacttcgctgttctgtggttttgcctcgatggccaagtggtatgatggcatcaggagctggcgaaacccgatcacaacaatgctggtgcacatgttgttcctgatactgatctgctacccggagctcatcctgcccaccatcttcctctacatgtttatgatcggaatctggaactatcgttacaggtcaaggcacccaccacacatggataccaagctatcacaggctgagtttacgcaccctgatgagctcgatgaggagtttgacacattcccatccaacagaccggctgacattgtgaggttgcgctacgacaggctgaggagtgtcggaggtcgtgtgcagacggtggtcggggaccttgcgacacaaggcgagagagctcatgctctgctgagctggagggaccctcgcgccaccgccatcttcatattcctgtccctggtcgtggccatcgtgctgtacgtgacgccgttccaggttttgctggtcatcactatgctctacttgctgcgccatccccggttccgcagcaggatgccctctgtcccgttcaacttctacagaagattgcctgccaagtccgattcgctcatttgaggccagagcacccgacggaagataaaatgggggaaccctgtaacattgtctccctctctcattctgttccttctggtaagcttcagatcagatgtgaatatacttggtgagttgattaattagaggcagtttggtggccctgtaataaggtgtcggttttatatgttttactgtctgcttatagttaggcagatagcgaagggaatgaccagataagatcccttcatagttttggatgaacattgttggctctggggtttctggcgtagagcagtggggtggggcacatgatcagttccattgtgttatgttaaatgtattggtgccagttttgttaatttcgtgttctgttgatcatgtccctggccgtgaccatgttctttctgtagtaagtatatccatgtgttgttcctatcgc

SEQ ID NO: 3243 - DNA, 2917 bp, Oryza sativa Japonica Group
agtaacccacgctgcggcgctccccccacgccaccaccaagcaactgttcggcggaatgccacactagaggcgagacccaaggacacgctccccacgccgcaaacaaagcgccgccgccgccgccgccgagatgaagggagcaatgccgccgcggccgttcatgatgccggggcctgggggcccgatgcccccgccgcagcagttcggcctggtggagacgcgcccgccgctggccgccgtgctgcggccgcggttcaacatcccgggcctccacccctccgccgccgcggcctccgcggcgggcaagatcgcgtccacctacgaccttgtcgagtcgatgcggttcctctacgtgcacgtggtgaaggccaaggacctccccgctgtctccgccgccggcaccatcgaccccttcgtggaggtgaagctcggcaacttcaagggcaccacgccggtcctcggcggcaaccacaacccgtcgtggaagcaggtcttcgccttctccgcgacgcacctccaggcgcacgtgctcgaggtggccgtcaaggccaaagatctcgccggcggcgacgacctcatcggccgcgtggggttcgacctctccgaggtgccgatccgtgtgccgccggactccccgctggctccccagtggtaccggctcgagaacaagcgtggcgagaagacccgcggcgagatcatgctctccgtgtggctggggacccaggccgacgaggccttccccgacgcctggcattccgacgcccatgcggcggccggcccgggggccgtcgcctccacgcgcgccaaggtatacttctcccccaagctcgtttacctccgcgtcgccgccatcggagcgcaggacctcgtgccgctggacgcgtcgcgccccgcgaacttctgcgtcaagctgcagctcgccgggcaggtgcggcgcacgcgccccggcgcgccgcccggcacgttgaacccgatttggaacgaggagttcatgttcgtcgtgtccgagcccttcgacgagccgctgttcgtcaccgtcgaggaccgcgtcgggcctggccgcgacgagcctctcggccgcatcatgctgcccctcaacgccgcaatgccgcgccatgaccacttcggcaagccggtggagccgcggtggtacagcctcgcgcgccccagcgacgatcctgacaagaaggaaggcaagttcgcgagcaagatacagcttcggatgtcgctggactttgggtaccatgttcttgatgagtccacctactacagtagtgatctccagccatcatcgaagcacacacggaagccaagcattgggatccttgagctggggattcttggagcacgaaacttgataccaatgaaggggaaagatgggcgcaccaccgatgcttactgtgttgccaagtatggaccgaagtgggtgcgcacgagaaccattctcaacactctgaatcctcagtggaatgagcagtatacttgggaggtgtttgatccttgcacggtgattacagtggtggtgtttgacaataaccagattggcaagaatggcgatgcccgggatgagagtatcggcaaggtgagaatccggctctctaccctggagactgacagggtgtacacccatttctaccctttgttggctctcaagcccagtggccttaagaagactggagagttgcatttggctgtgcgatttacatgtacggcatgggtgaacatgattgcgctgtatggccgtccattgctgccaaagatgcactacacacagccaatctcagtgatgcagttggattacctgaggcaccaggcaatgcagattgtcgcggcgaggcttagccgtgccgagcctccacttcgcagggaggttgtggagtacatgctcgatgtgggatcgcacatgttcagtctccgccgcagcaaggccaacttctaccgtatcacctcgctgttctgtggttttgcagcgacggccaagtggtatgatggcatcagaagctggcgaaacccaattacaaccgtgttggtgcatatgttgtttctaatactgatctgctacccagagctcatcctgcctaccatcttcctctacatgttcatgattggattatggaactaccgttacaagccaaggcatccaccttacatggacactaagctatgccatgctgagtttacaaacccagatgagcttgatgaggagtttgattcattccctagcagcaggccagcggacattgtaagaatgcgctacgatagactaaggagtgttggaggtcgtgtgcagacagtcgttggtgacctggcgacacaaggtgagagagcccatgctttgcttagctggagagaccctcgggccaccgccatcttcatattcttgtccctggttgttgccattgtgctgtatgtgacaccattccaggttctgctggttattgcaatgctatacctgttgcgccacccccggttccgcagcaggatgccctctgtgcctttcaacttctacaggagattgcctgccaagtctgatatgctcctttgagcccaatgcattgagaacaagagaaaatggaggaaaccctgtaactttgtttctctcttccattcagttccctactgattagcatcagatcagatgtgaatatacttaaggagttggtaaattagaggcaagttagcggccagggaataatgtgttcattcgaatgttatttgctcagataggcagaaagaagggattgactggaccccttcgagtttgggggggcagagtttgttaatgtcgtgtttcttggggtaagaacaataggcaggcgcaagctaatcttcagtgtattttgtttatggatttgtgccaattttgttattttcttcatgtaatcatgtactacctgttggatgatgatgttttgc

SEQ ID NO: 3244 - DNA, 663 bp, Sorghum bicolor
atggcttgcactgtcgcttccaggagggccgtcccgcttgtccgcgcgctggagaagctccttgccgcgtcgtccgcgcccggggctggctccaccctcaggccggtggcagtcgccggcggtctccgcgggtacaacaccggcgctcagctccgacgttacgaggggcgcgagtcggaagacgatagcgtccgcgagtacgagagccggcgcggcagccgggactacgccgcgcccagcctgttctcagatgttttccgtgatccgttcagtgcgccgcagagcctcggccgcctgctgagcctgatggacgacttcgcggtggcggcgccaggccgtgccggtgcggtgcgccgtggctggaacgcgaaggaggacgaagaggcgctgcacctgagggtggacatgccgggcctgggcaaggagcacgtcaaggtgtgggcggagcagaacagcctggtgatcaagggcgagggcgagaaggagtccggcgaggacgaggacgtcccgcctccgaggtacagcggtcgcatcgagctcgcgccagaggtttacaagatggacaagatcaaggcggagatgaagaacggcgtgctcaaggtggtcgtgcccaaggtgaaggaggagcagcgcaaggacgtcttccaagtcaacgtcgagtag

SEQ ID NO: 3245 - DNA, 1064 bp, Zea mays
aaccgcaaggatccaccacaacagcgaaggagaaagcagaccaacctagccacccagggagaaaggccaaaagggaggggagagtgtcgtcatggcttccattgtcgcttccaggagggccgttcctctagttcgctctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaacccaaaaaaaaaaaaaaaa

SEQ ID NO: 3246 - DNA, 1028 bp, Zea mays
ccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaaccc

SEQ ID NO: 3247 - DNA, 1012 bp, Zea mays
agcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcaggtaatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaaccc

SEQ ID NO: 3248 - DNA, 1443 bp, Oryza sativa Japonica Group
aacgcaaaatccaaaagataagcacagttacgcagcgagagcgagagaggagtggagagccatggcttccatcgtggcatcgaagaggatcccactgttccgcctcgtggagcagctcctcgccgcgtcgccggcccaaggcgccgcctccgctctcaggccggtggccgtcgccggcgggtcccgtgcatacaacaccggcgcgcagctccgccggcacgagagggacgagtcggacgacgacagcggccgtgggtacgacaccaggcgccccacacgcgacgccaccatgcccgccttcttctcagatgtgttccgtgatccgttcagcgcgccgcagagcctcgggcggctgctgagcctcatggacgacctggcgacgccggccgggcgcgccggcgccgcgacgctgcggcgcgggtggaacgcgaaggagagcgaggaggcgctgcacctgagggtggacatgccgggcctggggaaggagcacgtgaaggtgtgggcggagcagaacagcctcgtgatcaagggcgagggggagaaggaggccggcgaggacgagggcgccgccccggcgaggtacagcggccgcatcgagctcgcgccggaggtgtacaggatggaccagatcaaggcggagatgaagaacggcgtgctcaaggtggtcgtgcccaaggtgaaggaggagcagcgcagggacgtcttccaggtcaacgtcgagtaggagctcaatccgcgcgcgttcggcgtgcgaagttgcaggatgcggatggatcgtctccttttatccaataagaaatgcggcgtgctgtagctttgttttgttttcgaagttatggagataaaagttttggtttacttatgataaaaaaattttacttatgcgattgatctcgtatcgcgagatctctcgcgtcgtggtcaaattcaggcggactccgcgcgaaaacggagcgagcgcgcacgtgaagcggaagaaccgtgcgcgagacaattaaagccaaggcgtccttcattttgctctacatatatccatgaaaaatcaaaacttggcgagaggaatcattttgctgtgcatgataaaattcaaaatttggttagaggaacccgttctgtaattggaatggtgacagaattcataaaaaaaatcaaaaacttggctagaggaatccgttcggtaatatgtatggtgagttggtgacagcagcttcaagctggattgctgaagcttcaagaagctatagctccatttcagtcaacaattttaacttgaaaaattgtttacgaatacttgacattgaacgaaatccaatgcgatatgtttgttgcatccttgaatagttatcatattctaggattgaattgtgaattgttgtcgtgtataggacttatatacaacattaccagaaaccttatcaatattggatgaacctaattttcggc

SEQ ID NO: 3249 - DNA, 2430 bp, Sorghum bicolor
cgactcccaactctgctccaggcttgcagccgcctctgctctcgattctcccgctctcccacagccccgtgctccccattccgccgcttcttccctccccaacctccccatccgcctttggccggcaactgtcggccctcgccgccgatggactcccactcttccccctcggctgcaccgccggccgccgctgaagcggggcggtacacgtacagcccaaggctgcgatggcagccggaggtggaggagtacttcgccgcggcgtacggccgcgaccacttcgcccgcatctccgaggccctcgcgcatccttcttgttattcttgtattcgtgtcaatactctgaagtcttccactgatgctgtcatgcataaactgatggatctagtatgtgaaaatgagctctctgctgcaatcaatggtgtggaggctgttgagctgaatggtggagagcaaccacatgaagggagctctctggtccacaagtgcccctatgcaggccttgaaaatgttttgtttgttcagggatcaggaccacatgtgctgtattatggtagccaaccagatcaagctgttaaggaagtagttgtaagtcgaaaatgtgcagagtcagttcttcggggtgcccaggtgtatgttcctggtgttttagcttgtagttcacatgttgaaaagggtgataaggttgcagtgtcagtcgctattgagcagcctgtcaaggaagatggctgggctgtgggcataacacgaggaaccgttttacagggattgcaatcagatgcacattatgaagaaaggacgggtttgtacattggtcaagggaccgctgcaatgtcaaggtctgcactatttcgtgttcctcatgggattgcagtagagatgactgagacaacccaaaaggcacccatgtataatgatgtgcttgaaggggagatatttcttcaaaatttaccaagtgttgtgactacccattttatagatccccagtcaggagagcgaatactagatatgtgcgctgctcctggaggaaaaacaacagcaatagctatccttatgagggacaaaggagaagttgttgcccttgatagatctcacaataaggtgatggatattctaaagttggcttctgagatggacttgagttgtattaaagcttataaacttgatgccctcaaatctgtgcggaaaactgatgaatcaagaaaccttggcatggctcataatcacagtgaagcaattgagacaccaacagaggacccttgccatgccacaatagatggcagttctactagtgtagatgaaggcaactcaacaacaacagtggtgcattctgatgacaaaaacctaaatgccaaaagatatattagcaaggcagaactcaggaagaatttaaggcggatgaagaatggacccggaagaaataattgctctggtggtagagttgaaaagtcaaaaggattttatcctaacagctttgatcgtgtcctccttgatgctccatgctctgcgcttggcttgagacctcggctctttgctggtgaggaaactctagaatcgctgaaaaatcatgcaaagtatcagaggagaatgtttgatcaagctgtcaaattagttcgtcctggtggggtgattgtttattcaacgtgtactataaatccaggggagaatgaggctttggtgaggtatgcattggatacctacaaatatctgtcactggtatcacagtatccaaaagttggagggcctggtattgttggttcatgtgagctgttcaacatgacatatactgaggaatggttgagagaggatgaagctgaacttgttcagaggtttgatccatcatcatctgtggataccattggtttcttcattgcgaaattcaatgttggagataaagatgaataaacaaaagggattgaaattcaatgtttgatacccgcaacttacagtagggatatcagcactttctgcaatcagaatggtgaacctatacccatggagcggaatgcaggctgtcccctgaaattttgtttgccagtgtttgatactccatccattctaaattataagtcgttttggcttttctagatacatagcttatgcacctagatatatactatgtctagatacataacaaaacttacatagaaaagccaaaaacgacattttgaaatggagtatatttcttttgttcgaagaacattgttcattacggagaaatgatgaggcaactaagattcaagcatttggacacaatatacttatacactggcggcactttgggctccaactccaatgatagaagtgaagacaggaagaggggtttgtcttggtaggcctttgcacttttaacaacgtaataacaacttttatttttgggttgcactttgtatacaagctaacttttatctacacctgcatggctcaaac

SEQ ID NO: 3250 - DNA, 2140 bp, Zea mays
caaccggcggccctcgccgctgatggactcccactcccccacctcggcggcaccgccggcagctgctgaaacggcgcggtacacatacagcccgaggctgcggtggcagccggaagtggaggagtacttcaacacggcgtacggccgcgaccactttgcccgcatctctgaggccctggcgcatccttcttgttattcttgtatccgtgtcaatactctgaagtcttccactgatgctgtcatgcataaactgctggatttagtatgcaaaaatgagctctctgctgtaatcaatggattggaggttgttgaactgaatggtggagaccaatcacaagaagggtgctctctggtccacaagtgcccctatgcgggccttgaaaatgttttgtttgttcagggatcaggaccacatgtgctgcattatggtagccaaccagatcaagctgttaaggaagtagttgtaagtcgaaaatgtgcagagtcagttcttcggggtgcccaggtgtatgttcctggtgttttagcatgtagttcacatgttgaaaagggtgataaggttgcagtgtcagtcgctattgagcagcctgtcaaggaagatggctgggctgtgggcataacacgaggaaccgttttacaaggattgcaatcagatgcacattatgaagaaaggaagggtctgtacattggtcaaggaactgctgcaatgtcaagatctgcaatatttcgtgttcctcatgggattgcagtagagatgactgagagggtatacaagctcccatctttcaatgatgtgcttgaaggggaaatatttcttcagaatttaccaagtgttgtgacggctcgtgtccttgatccccagtcaggagagcgaatactagatatgtgcgctgctcctggaggaaaaacaacagcaattgctatccttatgagggacgaaggagaagttgttgcccttgatagatctcacaataaggtgatggatattctgaagttggcttctgagatggacttgagttgtattaaagcttataaacttgatgctctcaaatctgtacggaaaactgatgaagcaagaagccttggcatggctgataatcacagtgaagcaattgaaacaccaacagaggacccttgccatgccacagtaggtgggagatctaccagtgtagacgaagacagctcaacaacaacagtggtgttttctgataacaaaaacctaaattccaaaagatacattagcaaggcagaactcaggaagaatttaaggcagatgaagaatggacctggaagaaataattgctctggtggtagagttgaaaagtcaaaaggattttgtcctaacagctttgatcgtgtcctccttgatgctccatgttctgcgcttggcttgagacctcggctctttgctggtgaggaaactctagaatcgctgaaaaaacattcgaagtatcagaggaaaatgtttgatcaagctgtcaagctagttcgtcctggtggggtgattgtttattcaacgtgtactataaatccaggggagaatgaggctttggtgagatatgcattggatacctacaaatttctttcactagtatcacagtacccgaaagttggagggcctggtattgttggttcgtgcgagctgttcaacaagacatatactgaggaatggttgagagaggatgaagctgaccttgttcagaggtttgatccgtcatcatcagtggataccattggtttcttcatcgcgaaatttgatgttggagagaaagatgaataaacaaacgtggctgaaattccaatgtttggcattcacaacttacgctagggatatcagcattgaattttctgcaatcagatggctcacgtatacccatggagtggaatgcagcgtgccccctgaaattttgtttgccagtgtttgatattttcttttgttcgaagaacattgttcattatggtgaaatgatggggcaaattagattcaagctcctgtagtcccgtttccaagaaaaaagttaccgggtacccgtatccgtccgggtgtaccgggtattttctgggtattggtcctcccattccgtcctgtatctagggagcatttaaccgggtagcaccagcaaaattgtcctgatttaat

SEQ ID NO: 3251 - DNA, 2295 bp, Oryza sativa Japonica Group
gttgggcgtcgtctccctgcgccgcctcccctcccttctctccccattccgcatcctccctcctgcgcgcaatcgcttccaggagcccctcccgccgcagccgcagatggattcctccgcctccgcctccgcctcccccacggcggcggcggcggctgacgcggaccggtacacgtacagcccgaggctgcggtggcagccggaggtcgaggagtacttcgccgccgcgtacggccgcgaccgcttcgcccgcatctccgaagccctcgcgcatccttcttgttactcttgtattcgtgtcaatactctgaagtcttccactgatgctgtcatgcataaactgatgaatttggtagatcagaacggactctgtggtggaattaatggtttggagattggtcagcagaatggtggagagcaagcacatgaagggaattctgtggtgcataagtgcccatattctggccttgacaacgttttgtttgtacaaggttcaggaccacatgcactgcactacaatagccaacctgaccaatctattaaggaagtgattgtaagtcgaaaatgtgcagagtcggttcttagaggagcccaggtgtacatcccaggagttttagcttgcagctcacatgttgaaaagggtgacaaagttgcagtgtcggttgctattgaacaacctgctgaggatggtggttggaccgttggtataacacgaggaactgttttacagggattgcagtcagatgcacatcatgaagaaagaaagggtttgtacattggtcaagggatcactgcaatgtcaaggtccggaatatttcgtgttcctcatggagttgcagtggagatgactgagagggtgtacaagctcccatctttcaatgatgtgctcgaaggggagatatttcttcagaatcttccaagtgttgtggctgctcgtgtccttgatccccagcctggagagcggattctggacatgtgtgctgccccaggtgggaaaacaacagcaattgctatcctgatgaaagaccaaggagaaattattgcccttgatagatctcacaataaggtgatggatattttgaagttggccgctgagatggacctaaattgcataaaagcttataagcttgatgcactcaaatctgtacggaagaccaatgaagcaaaatatattggcgaagcaggcagccgcactgatgcaattgtgacactggcagaggactctgagccttgtattaataaagtcgatgctgggactactaatgccagtgaagacagttctactacatcagttgttcagactgataacaaaaaaacagatgataaaagatatgtgagcaaggcagacctcaggaagaacttaaggcgaatgaggaatggaccaggaagaaataactgctcaggtggtagagttgaaaattctaaaggatttttgcccaatagctttgatcgtgtcctccttgatgctccatgttctgcacttggcttaaggcctcgcctctttgctggtgaggaaacgctggaatcactgagaaatcatgcgacgtaccagagaagaatgtttgatcaagctgtcaagctagttcaccctggtggggtgattgtttattccacgtgtactataaatccaggagaaaatgaagctttggtcagatatgcattggataagtacaagtttttgtcgctcggatcacagcacccaaaagttggaggacctggtattgttggttcatttgagcgatcaaccaagaaatatactgaggagtggttgacaaagcatgaatcacaacttgtccagagattcgatccatcatcaactctggatacaattggtttcttcattgcaaagtttgatgttgggcagaaagacgactgacgtaaggggttctcttgagcattctattttggatcctacactctgaaacttgctgttcctgacttcaaatatctcagcattaacacttgctgcagttagatcatttcagggccccaatcatttttcagtatgaatgggaaccaatatcccatatctggtttcccagaaattttgtgctcaactgtcaatattaaattattctttgtccaagggattattgtttgttgtaatgaaatgccaagggtgactggttgaaagtagaaacatttgtaaacccaaaatgatagggacttgagattttagatgttgggtggtggggatatggagctggaagagtggagttgtgctttgtatggcttagcatatttaactaaatcaatttcttttctatcacatggcagtatagcatactttctccg

SEQ ID NO: 3252 - DNA, 3155 bp, Zea mays
aaccatcacttgttctctcttctctctctctcgtcgtgtgcctgggtcgaccagcgacctggctagctagctctccagctgcgcgcgccatggccaacccaacagctaccaagcatgctttcaagcgtattttgacgagcctgcttaagcctggcggtggtgaatacggcaagttcttcagccttccggcgctaaatgatccaaggatcgataagcttccctactctatacgtgttctcctggaatcagctatccgccattgtgataacttccaagttacagagagtgatgttgagaaaatcattgattgggagaacacatctccaaagctggctgagatacctttcaagccagcgagatgcattctaatggacaacactggagtcccagcagttgtagaccttgcagctatgcgtgatatgatgccaaagttgggatgtgatccctacaagattaatccattgattcccgtggatgctgttattgaccacgcagtgcgagtggatgtagcagggacctatgatgcattggatagaaacgaggagctggagttccaacgcaacaaagaaaggtttgcttttcttaaatgggcatccaatgctttccacaacatgcaggttttccctcctggttcgggcactgtacaccaggtaaatcttgagtatcttgcccgagttgtcttcaacgaagatggcattctttacttcgacagcgtggttggcacagactcacacaccactatgattaatagtcttggagttgctgggtggggagtaggcggtattgaagcagtcgttgcaatgcttggccagccaatgggcatggttttgcctggtgtggttggattcaaattgagtgggaagttacgggatggtgtcactactactgacattgttcttaccatgacccaaatgctaaggaagcacggtgctattggcaaattcgttgaattctatggtgttggtgtgggcgagctatctttgcctgctagggccacaattgccaacatgtctccagaatatggagctaccatgggcttcttccctgtagaccaagtagcattggactatctcaaactgacaggccgaagcgatgaaactgtgtcgatgattgaagcatacctgcgagctaacaaaatgtttgtggacaagcatgagcctgagacggaacgcgttttctcttcacatctggagctggaccttagtgaggtggagccttgcgtttcaggccccaaaaggcctcatgatcgtgtccctttgaaggaaatgaagtcagactggcatgcttgcctggacaacgaagttggcttcaagggctatgcggtgccaaaggaacagcaaggcaaagttgtgaaattcgacttccatggaaggccagctgaaatcaagcatggcagtgttgttcttgcagcaatatgtagctccacaaacacatcaaatcccagcgtcatgattggtgctggccttgtggcaaagaaagcctgcgaattaggccttgaggtgaagccatgggtaaagacaagccttacccctggatctgtggttgctaccgagtacttgaaacatagtggccttcaagattatctgaaccagcaagggttccatgtcgctgcgcatggttgcgccacttgtgtgggcaactccggtgacctggatggatctgtatcagctgctatcacagaaaatgatatggttgctgctgcggtgctgtcggccaaccgaaacttcgaggggcgtgtgaaccctctcactcgggctaactaccttgcctcgccgcctctggttgttgcctatgctcttgccggcactgttgacattgactttgagaaagagcccattggagttggaaagggtggtaaggaagttttcttgagggacatatggccttcaaaccaagagatcgatgaggttgtggagtccagcgtgcagactcacctgttcaagaaagtgtacgactcaatcatggaacgtaaccctaggtggaaccagctgccggttccaaaggaggcactgtacccatgggaagacaggtccacctacatccgcaagcctacgtacctggagggcatgtccatgacgccgcctgcagccccgcccacggtgacggaggcctactgcctgctcaaccttggggacagcatcaccacggaccacatctcctactcggggaagatccccgagggcacacctgcggccaagtatctgctcgagtatggcgtggagcccaagaacttcagctcctatggtggccgccgcgggaacaacgaggtggtgatgaggggagcgtttgccaatatgaggatcgtgaataagcttcttgatggcaaggctggtccctggacgatccatgttcctaccggggagaagctctatgtttacgacgcggcaatgaagtacaagtcggaaggtcatgacatggtcatcattgctggctccgagtacggcagtggcagctctcgtgactctgctgccaagggaccaatgctactgggtgtcaagtcggtgattgcaaagagcttcgagcggatccaccggagcaacttggtggggatggggatcattcctctctgctttaaagcaggagaggatgccgattcactcggcctcaccggacgtgagcgctacaccatccacctccctaccagcaccgccgagctcagtccaggccaggacgtgaccgtcacaacccacgacggcagatccttcacttgcactcttcgcttggacacacagcttgaggtcacatacttcaaccatggaggcatccttccctacatggtccgcaacctggcagcacagatgaaataagttaaaaagcaagctagcttattggcgcggtgggaataaattaaaaaggtactcagtgccccacgtatttgacgtatgtctgtaaataagtggcacattcgagcgctcttcgctctgccattgaggtggatcgaagctgccacatattttctccgcaggacatcggcacgaattttgtcttagcaaaccagttaattttgtactctttagattctttaattggttccatgctctctttggtacttttcatgtcagtttgctttgcaaacattatcagcgtgcccttgtagatttcgtaatggttatatgtatatgccctattgaaattgtcaaaaaaaaaaaaaaaaa

SEQ ID NO: 3253 - DNA, 3648 bp, Sorghum bicolor
atgtataaagccgccaacgcccgcctcctcctcagatccctctcctccaactcagctgcgtcagcctccgtgcccgtcaacaacccgcgcctcgccgccgcatcctcctcctcctccgccgcccgcctcgcgctctcgctgccgtgcggcgcgtgggtcggccgcagcagcgggctcgtccgcgccgccggttggtccgggacccgaccgcgctttgccggcgccagggcgcagatcggcgccgccgccgtgcccgccgtcgagcggttccagcgcaggatggcaacccaagctactgagcatgccttcaaggatattctgaccagcctccctaagcctggaggtggtgaatatggaaagttctacagtcttcctgcactaaatgatccaaggattgataagctgccctactccatccgtattcttcttgagtcagctatccgtaactgtgataacttccaagttaccaagaatgatgttgagaaaataattgactgggaaaacacatctccaaagctggctgagataccattcaagccagcacgagttcttcttcaggacttcactggagttccagcagtcgttgatcttgcagctatgcgtgatgcgatggccaagttgggaagtgatgccaacaagatcaacccattggtcccggtggatcttgttattgatcactcagtgcaggtggatgtagcaaggtcgcagaacgccgtacaagcaaacatggaactcgaatttagtcgcaacaaggaaagatttggtttccttaaatggggttctagtgctttccaaaatatgctggttgtcccccctggttctggtattgttcaccaggtcaatcttgagtatcttggcagagttgttttcaacacagatggcattctctatcctgacagcgtagttggtactgactctcacaccactatgattgatggtttgggtgttgctggctggggggtcggtggtatagaagctgaggctacaatgcttggtcagccaatgagcatggttttgcctggtgtcgttggcttcaaattaactgggaagttacggagtggtgtcacggccactgatcttgttcttacagtgacacaaatgctaaggaaacatggtgttgtcggcaaatttgttgaattctacggtgaaggtatgggtaagctgtctttagctgacagggccacaattgcgaacatgtcaccggaatatggagctaccatgggcttctttcctgtggaccatgtgacattggattaccttaaactgacaggccggagtgatgaaacagtgtcaatgattgaagcatatctgagagccaacaaaatgtttgtggactacaatgagcctccaacagagagaatatactcatcttatcttgagctggaccttgatgaggtggagcctagcatgtctggaccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcacgggcagccggcagaaatgaagcatggtagtgttgttatagcagcaataactagctgcacaaacacctcaaatcctagtgttatgcttggtgctggtcttgtagctaagaaagcctgcgagttgggtcttgaggttaaaccatgggtgaagacaagccttgcccctggatcaggagttgtcacgaagtacttgcttcagagtggccttcaagaatacttgaaccagcaaggatttcatattgttggctatggctgtaccacttgcattggaaactctggtgatctcgatgaatctgtatcagctgccattacagaaaatgatgttgttgctgctgctgttttgtcgggtaaccgtaactttgagggtcgtgtgcaccctttaactcgggctaactatcttgcttcgccacctcttgttgttgcttatgcacttgctggaactgttgatattgattttgagaaagagcccattggacttggaaaggatggcaaggaagtctacttcagggatatatggccctcgacggaagaaattgcacaggttgtccaatccagtgtgctgcctgacatgttcaagggcacctatgaggctatcacaaaaggcaacccaatgtggaaccagttaactgtcccagaagcgtcactgtattcatgggattccaaatccacttacattcatgaacccccgtactttaaggacatgaccatgtccccacccggtccctctgcagtgaaagatgcatactgcttgctgaacttcggggacagcattactacagatcacatttcacctgcaggaagcatacacaaagacagtcctgctgccaagtatttgatggagcgtggtgtggaccggaaggacttcaactcttatggtagccgtcgtggtaatgatgaaataatggcgaggggaacatttgcaaacattaggatcgtgaacaagtttttgaatggagaagttggacccaagaccattcatgtccctactggggagaagctttacgtttttgatgcggccatgagatacaaatctgagggccatgctactataattctcgctggcgctgagtatggaagcggcagttctcgtgattgggctgccaagggtccgatgctcctgggagttaaagctgtgattgccaagagcttcgagcgtatccacagaagcaacttggtggggatgggaatcattcctctctgcttcaaagctggtgaggatgctgattcgcttggcctcactggacatgagcggtacagcatcgatctccctgccaacctcagtgagatccgtcccggccaggatgtgactgttattaccgacaatgggaaatctttcacttgcacccttcgctttgacactgaggtggagctggcgtacttcaaccatggaggcatcctcccctatgtcatccgcaacttggctggtgcgcagaactaaggcagatcacactccattttgcctacaatgacagtggcaggctccatcttcccagggctagcggcctggttcaatgtagagactatgcgatgcctctcgagggcctttgtcgattcagccccataaataaagtgtgaaataaaaagtcataggaggaggcaggaaccgctgattgaggaacaggtttgcctgttgattggttacatgaaatttctgtttcacaggcgtgcagagcatggtgtaaatgctttctatgttactttcgttgtgacaaattgcttatgctgttatgctctcaagccctttaggttgcatcacattttggtgtcttatgaaacacattcttttttctgatggtggtaatgttttccgtaggctagtagccaatagtttgtttgggttctatctctctctattctaatctaattagtggataagaaattgttgcttggagggtgaactttgcttagcctgatcgggagctgaaaatgtgatccagcctgagactaagcgattgttaggccagtctcaatgcatagtttcatggcatagttatcaagtcaattaggtaaccgagctatatgatttttgctctctctcttcaataactaccttgccacatcagcaaaatttttaggtgacaccataattaatgtt

SEQ ID NO: 3254 - DNA, 3129 bp, Hordeum vulgare subsp. vulgare
gggctccccccgaccccgtatatgtatgaagctgctgcctcctccgcccgcctactcctgctcctcctccgccccagatccctccgcccgccaccgcctccgcctcccaccgccgccccagcttccccgcgcctccttccctccgcccgcctcgcgcccgttcgccggaccccgccgcgccgcccgactgcggtgctcgccgtcgtccgccgcggtcaggggcaggggcagcgtcgcgcctgccgcccagcggtcccagcagcgcaggatggccgcctcaggtactgagcatgcctacagcaatattttgaccagcctccctaagcccgggggtggtgaatatgggaaattctacagccttcctgcactaaatgatccaaggatcgataagctgccctactctatccgtattcttctggagtcagctatccgtaactgtgatggcttccaagttaccaagaatgatgtcgagaaaattgttgactgggagaacacatctccgaagttggctgagatacctttcaagccagcacgagttctgctccaggacttcactggagtcccagcagttgttgatcttgcagctatgcgtgatgcgttggccaagttgggcagcgatgcgaacaagatcaatccattggttccggtggatcttgttattgaccactcggtgcaggtggatgtagcaaggtcgaccaatgcattgcagtcgaacatggagctggaatttacccgcaacagagaaagatttggttttcttaaatggggctcaactgctttccacaacatgctggttgttcccccgggttctggtattgttcaccaggtcaatctcgagtatcttggcagagttgttttcaacacagatggcatcatgtaccctgacagcgttgttggcactgattcacacaccactatgattgatggtttgggtgttgctggctggggagttggtggtattgaagcagaggctacaatgcttgggcagcccatgagcatggttttgcctggtgtggtcgggttcaagttgactggaaagctaaggaatggtgtcactgccaccgaccttgttcttactgttacccaaatgctaaggaagcatggtgttgttggcaaatttgtcgaattccatggtgaaggtatgggcaaattgtctttggctgacagggccacaattgctaacatgtcaccagaatatggagctaccatgggcttctttcctgtagaccatgtgacattagattatctcagattgactggccgaagcgacgaaactgtttcaatgatcgaagcatatctacgagctaataatatgtttgttgactataatgagcctcaagcagaaagagtttactcttcgaatcttgcgctggaccttgatgacgtagagccttgcatttctggcccaaagaggccgcacgaccgtgtcactttgaaggaaatgaagtcagattggcatgcttgcctcgacaacaaagtcggtttcaagggctttgcggtgccgaaggaacaacaggataaggttgtgaaatttgactttcatggacaacctgctgaactcaagcatggcagtgttgttatagcagcaattactagttgcacaaacacatcaaatcccagcgttatgcttggtgctgcccttgtcgcaaagaaagcttgcgaattgggtcttgaggtcaaaccatgggtaaagacaagccttgcccctggatctggggttgtcactaaatacttgctaaagagtggccttcaagaatacttcaacaagcaaggattccatcttgttggatatgggtgtaccacgtgcattggcaattctggtgatctcgatgaatctgtatcagctgtcattacagaaaatgatgttgttgctgctgctgtgttgtcgggcaaccgtaactttgaggggcgtgtgcaccctttgactcgggctaattaccttgcttcaccgcctctggttgttgcatatgcacttgctggcactgttgacattgattttgagaaggaacccattggtgttggaaaggatggcaaggaagtttacttcagggatatatggcccacaactgaggaaattgctgaggttgttcaatccagtgtgctgcctgacatgttcaggagcacatatgaggccatcacaaaaggcaacccaatgtggaaccagcttcctgtcccagaagcatcgctctactcatgggattcaaactccacttacatccatgagcccccctacttcaaggacatgaccatgtccccacctggcccacatgcggtgaagaacgcctactgcctactcaactttggagacagcattaccacggatcatatttcacccgcaggcagcatccacagagacagtcctgctgccaagtatctgcttgagcgtggcgtcgaccgaaaggacttcaattcgtatggtagccggcgtggtaatgatgaggtgatggcaagaggaacatttgcaaacatcaggattgtgaacaagtttttgggtggagaggttggacccaagactattcatgtccccacaggcgagaagctctctgtcttcgatgcagccttgaaatacaagtctgaaggtcatgatacgatcattcttgctggcgccgagtatgggagtggcagttctcgtgattgggctgccaagggaccaatgcttctcggtgtgaaagcggtgattgccaagagctttgagcggatccaccgaagcaacttggtcgggatgggtatcatcccgatgtgcttcaaagccggcgaggatgccgactcactcggccttactggacatgagcgctacaccattaaccttcccaccgacgtcggccagatccgtcctggccaggatgtgaccatcaccacggaagacgggaaatccttcacttgcatacttcgctttgacacagaggtggagttggcctactacaaccatggaggcatcctgccctatgtaatccgcaacatggcaggagctcagaaataggcgaacgcggccacatacccttttcgacctagatggcggcatggcagtcttgttagtgccaccgtggacatcaagagtttgctcattatgttgtggccttatgaataaaccgaaaataaagctggcatttccatgcctggcgtgggcgc

SEQ ID NO: 3255 - DNA, 3331 bp, Citrus clementina
ctcacttacagaagctgccaccctctcttcccatctttctagcagcttcggctctcattctgttagggtttcaaattcattttaatttaggttaatttgatttaatctaaatttccagaaacgacgtcgtaatgcatattccgagttcttcagcgtctcgcgcacgcttcgcctcctcaactctttcgaaattctcttcgtcgttttcatttttgcctgctttatctaaaacgacgccatctgcttacagttcctctcagtcgtgcgtttcctttgttaaccagaagtaccgttctctgagtttctcgtcggcgctccgaactctacggtgctcggcgccgcggtggagccacggcgtcaactggcgttcaccagtcagtctccgcgctcaatctaggatcgccgctccggttctagaacggtcgagcgaaagatcgcctctatggctcctgaaaatgctttcaagggaattctcaccagtcttcccaagcctggtggtggagagtttggaaaattcttcagcttaccagctttgaatgatccgagaattgacagactaccttactctataaggatccttttggaatctgcaattcggaattgtgacaatttccaagttacgaaggatgatgtagagaagattattgattgggaaaatacttcacccaagcaagttgaaattcccttcaagcctgctcgggttctcttgcaggattttactggagtgccggctgcagttgacttggcttgcatgagagatgccatgaagaatctcaacagtgatcccaagaagataaatccattggttcctgttgaccttgtcgtagatcattcagttcaggttgatgtggcacgatctgaaaatgcagtacaggccaatatggaatttgaatttcagaggaaccaagagaggtttgcttttcttaagtgggggtcatctgcttttcataacatgcctgttgttcctcctggttcaggaattgtccatcaggttaacttggaataccttggacgggttgtctttaatactgatggcatcctctaccctgatagtgtgggtggtactgattctcacacaaccatgattgatgggttaggagtagctggttggggagttggaggaattgaggctgaggcagcaatgcttggtcagcccatgagcatggttttgcctggtgttgttgggttcaagttgactggcaagttacgagatggggttacagctactgatttggttttgactgtcacgcaaatgttgaggaagcatggtgttgttggcaagtttgtagagttctatggggaaggcatgggtcaactaccattggctgacagagccactattgcaaatatgtctcctgagtatggagcaaccatgggcttctttcctgtggaccatgttacattgcagtatcttaagttaactggaaggagtgacgagacggtctctatgatagaagagtatttgcgtgcaaacaaaatgtttgttgactacaacaagcctgaacaagaaagatcatactcatcatatctgcagttggatctagcagatgttgaaccctgtatttcaggaccaaaaaggcctcatgatcgagttcctctgaaagacatgaaggctgactggcatgcatgtcttgaaaatcaagtcggattcaagggttttgctgtacccaagcaagagcaggataaagtggcaaaattttcattccatggacagcctgctgaacttaaacatggtagtgttgtcattgcagccatcaccagctgtacaaacacatcaaaccctagtgtcatgcttggggctggtcttgtggctaaaaaggcttgtgaactaggtttggaggttaagccatgggtcaaaacaagccttgcaccaggctctggtgttgttacaaagtatctgcaacagagtggcctgcaaaagtacttgaaccaacaaggttttcacattgttggctatggctgcactacttgtattggaaactctggagatcttgatgaatcagttgctactgcaattacagaaaatgacattgttgcagctgctgtgctttccggtaatcggaactttgaaggtcgtgtacatcctttgacaagagctaactatcttgcatctcctccattagttgttgcttatgcccttgctggcacagttgacatagactttgaaaaggagccaattggaactgggaaagatggaaagggtgtttactttaaggatatatggcccagtaatgaagaaattgcagaggttgttcaatctagcgtcttacctgacatgttcaagagtacttatgaggctatcacaaagggcaaccctatgtggaatcagctgtctgttccgacttccatgctttactcttgggatccaaactcagcatacattcacgagcctccatatttcaagaacatgactatggagccaccaggtccccatggagtgaaggatgcctattgcttgctcaattttggtgacagtattactaccgatcatatctctccggcaggaagtatccacaaggacagccctgctgcaaaatatctgcttgagcgtggggtggatcgcaaggacttcaattcttatggtagtcgtaggggtaatgatgaagtgatggcaaggggtacctttgccaatattcgcattgttaacaagctcttgaatggagaagttggcccaaaaacagttcatattccaacaggagagaagctttatgtttttgatgcagcaatgaggtacaaggctgctggccatgagaccattgtcctagctggagcagagtatggaagtggcagttctcgtgattgggctgctaagggtccaatgcttctgggtgtgaaagcggtgattgccaagagctttgagagaattcatcgtagtaatcttgttggtatgggcatcattcctctttgcttcaagcctggggaggatgcagacacactggggttagctggtcatgagcgctacacaatcaacttaccaaataaagtcagtgagataaggcctggccaagacattactgtcacaaccgacactgggaaatccttcacatgtacagtacgctttgatacggaggtggaactggcatatttcgaccatgggggcattcttccatatgttatccggaatctgattaaacagtaaataactgagctcttgattcagggccatggggcatgaggcatggggattcataaaaagatcagaaaggaaatatattttttgtttcgtcaacttcttccaataggattagcgtttcattctttcacttttctgtagttttcacttcatttttcttttggccaaagttgtttatttaaattaaaaaaaaaaaaa

SEQ ID NO: 3256 - DNA, 2945 bp, Litchi chinensis
aagcctggtggtggtgaatttggaaagttttatcgccttccagctcttaatgatccaaggattgataagctgccatactctatcagaatccttctggaatctgcaattcgtaattgtgacaacttccaagttaaaaaggaggatgttgagaaaattattgattgggagaatacttctcctaagctagttgaaattcccttcaagcctgctcgtgttctcttgcaggactttactggagtgccagctgtggttgaccttgcatgtatgcgcgatgccatgaacaagcttggcagtgattctaacaagatcaatcctttggtacctgttgatctggtcattgaccattcagttcaagttgatgtaacaagatctgaaaatgcagtacaggcaaatatggagcttgaatttcagaggaacaaggagagatttgctttccttaaatgggggtcaactgccttccataatatgcttgttgttcctcctggttccggtattgtgcatcaggtcaaccttgaatatctggggcgggttgttttcaatactgatggcatactatatcctgatagtgtggtcggaactgattctcatacaaccatgattgacgggttaggagttgcagggtggggtgttggaggtattgaagcagaggcagcaatgcttggccagcctatgagcatggtgttgcctggagttgttgggttcaagctatcaggaaaactgcacaatggggtaactgccactgacttggttttgactgtgacacaaatgctgaggaagcatggtgttgtcggcaaatttgttgagttctatggtgatggtatgggtgaactttcactagctgacagggccacaattgctaatatgtctcctgagtatggtgcaaccatggggttcttccctgttgatcatgttactttacaatatttgaaattgactggaaggagtgatgaaacagtgtccatgatagaaggttatctccgtgcaaataaaatgtttgttgactataatgagccacaacaggaaagggtgtactcatcatacctagaattgaacctggctgaagttgaaccttgtatttctggacccaaaagacctcatgatcgggttcctttgaaagaaatgaaggcagattggcattcatgtcttgacaataaagtcgggttcaagggctttgctgtacctaaagaggcacaagaaaaagttgctaagttttcattccatggacagccagcagagcttaagcatggtagtgttgtgattgctgcaattacaagttgcaccaatacatcaaaccccagtgtcatgcttggtgctggtctggttgcaaagaaggcctgtgaactcggtctacaggtcaagccatggataaagacgagtcttgccccaggctcaggagttgttactaaatatttactccagagtggactgcaggaatatttaaatcagcaaggtttccacattgttggatatggctgcacaacatgcattggaaattctggagaattggatgaatcagttgcttctgctatttcagaaaatgacgttgtagcagcagctgtgctttcagggaacaggaattttgagggtcgtgttcatcccttgactagagccaattaccttgcttcacctccattagttgttgcttatgcccttgctggaacggttgacatagattttgagaaggagcctattgggacaggcaaggatggtaagagcgtttatttaagggatatctggccatctacagaagaaattgcagaggccgttcaatccagtgtattgcctaatatgttcagaagtacttatgaggctataacaacgggcaaccccatgtggaatcatctatcagtgcccactgatacactgtactcatgggaccccaactcaacctacattcatgagcccccatacttcaagaacatgactatggatccacctggaactcatggagtcaaggatgcctactgcttactgaacttcggcgacagtatcacaaccgatcacatttctccagcaggaagcatccacaaagacagtcccgctgctaggtatctcatggagcgtggagtggagcgcaaggacttcaattcttatggtagtcgtcgtggtaatgatgaagtgatggctaggggaacttttgccaatattcgccttgttaacaagctcttgaatggggaagttggcccgcagactgtccatgttccgacaggggagaaactgtttgtgtttgatgcagcacagaggtacaaggacgctggccatgacacgattattttggctggagctgagtacggaagtggaagttcccgtgattgggctgccaagggtccaatgttgttgggagttaaagcagtgattgccaaaagttttgagagaattcaccgcagcaacttggtgggaatgggcattattcctctctgcttcaaggccggtgaggatgctgacacactaggactgactggtcatgagcgttataccattgatcttcctaatagcatcagcgagatcagacctggccaggacgtgactgtcacaactgatacaggaaaatctttcacctgcacagttcgctttgacactgaggtggaattggcatatttcaaccatggaggaattcttccatatgtcatccggaacctgattgagcaatagagtaattgcatcatttatcagacatctttgtttcatccaaggaaactttggatttgtataatgtgagaagtgaataaagtctcaaaatcatagagaaaaatatatccctttcagggacaagaggcaatttttttttttttttttgaagcacttccaggtcgacaaatgactattttcagtaattttcttttcttttttcatgttcaatagttgctccaatgtgctgtaaaatcgtccgaattcaacatagaaataaattaatatgggtatgttttgttgaaaaaaaaaaaaaa

SEQ ID NO: 3257 - DNA, 3563 bp, Ricinus communis
tagaagaagggcagcgaggcacgcagccctaggttttccgttgctcgccacacgcctctgtctctttctctttctctctctctcttaaatcattttatgaagtagttgctggctgctttttatctgtaattcttcctctgttagtgtgatcaaattaatcaaaagttcttatcttttcgttgtggtgtttttatgtgaacaatcgtcatgtatataatgacggcttcaagcacagcctcctcgctcttgagggcgtctagggctagactactttcttcttcttcttcttctgttatttctaggacgacgccgttacctccgccgttgcctaaattctctgttacgaaccgatctcttagcttctccgccgccgttcgatctctccgttgctctgtccctcgctggagtcacggtgttgattggcggtctcctgttagtctccgctctcagatcagaactgcttctccggttatcgaacgcttccagcggaagatctctactatggctgctgaacatcctttcaagggaatcgtcacacctctccccaagccaggtggtggtgagtttgggaagttttatagccttcctgctctcaatgatccaaggattgataagctgccctattcaatcagaatccttcttgaatctgcaattcgcaattgtgacaacttccaagtgacaaagcaagatgtcgagaagatcattgattgggaaaattcagctcctaaacaagttgaaattcctttcaaacctgctcgtgttctgttgcaggattttactggcgtaccagcagttgttgacctcgcttccatgcgtgatgctatgaacaagcttggtggtgattccaacaagatcaatcccttagttcctgtggatttggtcattgatcattcagttcaagttgatgtcacgagatcagaaaatgccgtgcaggcaaatatggagcttgaatttcagaggaacaaggagagatttgcttttcttaaatggggatcaaatgcatttcaaaatatgcttgtagttcccccgggttctggtattgtgcatcaggtgaatcttgagtatcttggacgtgttgttttcaacaaagatggcattctctaccctgatagtgtggttggaactgattctcatacaaccatgattgatgggctaggagttgctggctggggtgttggaggtattgaggcagaagctgcaatgcttggtcagcccatgagcatggtgttacctggtgttgttgggttcaagttgtctggaaaactgcacaatggtgtcactgctactgacttggttttgactgtgactcaaatgctgaggaagcatggtgttgttggcaaatttgttgagttttatggggaaggtatgggtgagctatcattagctgacagggccactatagctaacatgtcacctgagtatggtgcaactatgggattcttccctgtggatcatgttaccttacaatatcttaaattgactggaaggagtgatgaaactatttcaatgattgagtcatatcttcgtgcaaataaaatgtttgttgattataatgagcctcaacaagaaagagtatactcatcctatctacaattggaccttggtgaagttgaaccctgtatttctggaccaaagagacctcatgatcgggttcctctgaaagaaatgaaggctgattggcattcttgtttggacaacaaagtcggatttaagggttttgctataccaaaagaggtgcaggaaaaagtggcaaagttctcattccatggacagccagcagagctgaagcatggtagtgttgtgattgctgcaatcacaagctgcacgaatacatcaaatccaagtgtcatgcttggtgcaggtcttgtggcgaaaaaggcttgtgaacttggtttacaggttaagccatggataaagacaagtcttgcccctggttctggagttgttacaaaatatttactgcagagtggattgcaaaaatacttgaatcaacaaggcttccatattgttgggtatggctgcacaacatgcattggcaattctggagatttggatgaatcagttgcttctgctatttcagagaatgacattgttgcagcagctgtgctttctgggaaccggaattttgagggtcgggttcatgccttgacaagagccaactatcttgcttcacctcctttggtggttgcctatgctcttgctggaacggtggacattgactttgacaaggagccaattggaacaggaaaggacggtaaagatgtctatttcagggatatctggccatctacagaagaaattgcagaggctgtgcaatctagtgtgttgcctcatatgttcagaagtacttatgaggctatcacaaagggcaatcccatgtggaatcaactaacagtaccagcaacaacctcatactcatgggaccctaactctacctacattcacgatcccccgtatttcaagagcatgaccttgaaccctcctggagcacatggagtgaaggacgcctactgtttgctaaacttcggtgatagtatcacaacagatcacatctccccagcaggaagcatccacaaggacagtcctgctgcaaagttcctccttgaacgaggggtggatcgccaggactttaactcctatggaagtcgacgtgggaatgatgaagtgatggctaggggaacctttgctaacattcgccttgttaataaacttttgaatggggaagtgggaccgaagacagtacacattcctacaggagagaaactctacgtgtttgatgcagcatcgaggtacatggctgctgggcatgacactattgttttggcgggagcagaatatggaagtggaagctctagagattgggctgccaagggtccaatgttattgggagttaaagctgttattgctaaaagttttgagagaatccatcgcagtaatttggtgggaatgggaattattccactttgtttcaagcctggtcaggatgcagatactctagggttgagtggccatgagcggtataccattgacctcccaagcaatattagtgaaataaagcctggccaagatgtgactgtcacaaccgataatggaaaatctttcacctgcactgctcgctttgacaccgaggtggaattggaatatttcaaccacggaggcattctgccatatgttatccgcaacctgatgaaaacagagtaaatcgttgggcggtggcttttttccatgccatgggagttttcaattgtaaaatgcgagaggagaaataaaaagttttcaataataggaaaaggaaatcatccctttcgtaggaagggacaggaaattcttttagcactttgtggtggattagcggtataaatattttctgtgttggtcataactcgagttccactgtgaatccatacatggtcatggaagtttcgtttatttatggaaactggtggtgtcctgtcctgtcctgtaaaaccaattctttataacacaattccctctttctcacgaataacaaatccatctgagtcttgattgcaaaataagattttcagctttccctttgctct

SEQ ID NO: 3258 - DNA, 3487 bp, Vitis vinifera
cgaattccttcttcagttctgcatcttcttcttcagctagggtttctgacagtctcacagaaaaattgatagtgccacgttctcgccatgtatatggccacttctccatattcttcactcgcgctcctcagagcctctagggttcgcttcgcgccttctatctctagagtttcgctgtcttcttcttcttcttcttcttctcctcatcctccttgtccctctagaatccccgcttctgcttcttcttcgtctttgcctttttccacgatcagtggtggttaccgttccttgggattcttgtcggcgtttcgatctcgtcgttggagccacggcgtcgactggcggtccccggtcagcctccgcgctcagatcagggccgctgctcctgtgatcgagcggttcgagcggaaaatggctactatagcttctgagcatccttttaagggaatattgaccagtgttcccaagcctggaggtggagagtttggaaagttctacagcctccctgctctgaatgatccaaggattgacaagctgccttactctataaggatacttctggaatctgccatacgtaattgtgacaacttccaagtaaccaaggatgatgttgaaaagattattgattgggagaatacttcaccgaagcaagttgaaattcccttcaagcctgctcgtgttctcttacaggactttactggagtgccagctgtggttgaccttgcctgcatgcgggatgccatgaacaaccttggcagtgattcaaacaagatcaatcccttggtgccagtggaccttgtcattgatcattcagttcaggttgatgtaacaagatcagaaaatgcagtacaggcaaatatggaccttgaattccagaggaacaaagagaggttttccttcttgaaatggggttcaaccgccttccgtaacatgcttgttgttcctcctggttctggtattgtccaccaggttaatctggaataccttggacgggttgtttttaacaatgatggtattctctatcctgatagtgtggttggtactgattcccacacaactatgattgatggactaggagttgctggatggggtgttggaggaattgaagcagaggctgcaatgcttggccagccaatgagcatggtattacctggtgttgttggatttaagctgtctggtaagttgtgtagtggtgtcacagcaactgacttggttttgaccgtgacacaaatgttaaggaagcatggtgttgttggcaagttcgttgagttctatggtgagggcatgggtgaattgtcattggctgatagggccaccattgcaaacatgtctcctgaatatggagcaacaatgggtttcttccctgtagatcatgttacattacagtatcttaaattaactggaagaagcgatgaaacggtagctatgatagaagcatatttgcgtgcaaacagaatgtttgttgattacaatgagcctcaagtagaacgattttactcatcttatctgcaattgaacctagaagatgttgaaccctgcatgtcaggacctaagcggcctcatgatcgagttcctttgaaagagatgaagactgactggaaagcatgtcttgataacaaagttggattcaagggctttgctgtaccgaaagaggcacaggacaaagtggccaagttttcattccatggacagcctgctgagctcaagcatggtagtgttgttatagcagctatcacgagttgtacaaacacatcaaatcctagtgtcatgcttggggctggtcttgttgcaaaaaaggccagtgaacttggcttggaggtcaagccatggattaaaactagtcttgctccaggttctggagttgttacaaaatatctgctccagagtggcctgcagaagtacttgaatcagcagggatttcatattgttggctatggatgcacaacatgtattgggaattcaggggatcttgacgaatcagtagcttctgcaatttcagaaaatgatattattgcagctgccgtgctctctggtaaccggaactttgaaggtcgtgttcatgcattgacaagagccaactatctagcatcacctccactagttgttgcttatgcacttgccggcacagttgacatcgactttgagaaggagccaattggtacaggaaaggatggtaaagatgtgtacttcaaggacatatggcctactagtgaagaaattgcagaggttgttcaatcaagtgtgttgcctgaaatgttcaagagtacctatgaggctatcacaaagggaaatcccatatggaatcagttatcagttcacagttcctctctttattcatgggatccgaactcaacctacattcatgagcccccatatttcaagaacatgaccatgaatccaccgggtcctcatggggtgaaggatgcctactgcttgctcaactttggcgacagtattaccactgaccatatttctcctgcaggtagcatccataaggatagccctgctgcaaagtatcttattgagcgtggggtggctcccaaggacttcaattcttacggtagccgtcgtggaaatgatgaggtgatggcaaggggcacctttgccaatattcgcattgtcaacaagcttctgaatggagaagtgggtccaaagacaattcacattccaacaggagagaagctttatgtgtttgatgcagcaatgagatacaaggctgatgggcatgacaccattgtcctagctggagcagagtatggaagtggcagctctcgagattgggctgccaagggcccaatgctacagggagtcaaagcagtgatcgctaagagctttgagaggatccatcgcagtaacctggttgggatgggaatcattcctctttgtttcaaggccggtgaggatgctgacacactaggcttgacaggtcatgaacgctacaacatcgaccttcctagtaagatcagtgagataaggccaggccaagatgtcaccgttacaactgacaatggcaagtctttcacatgcacggtccgctttgacacagaggttgagttggaatattttaatcatggtggcattcttccttatgccatccggaacctgatcaaccaatgaggaaatttgctgtggaattggtggcttaggcatatctccagtcatcagcgaagggttgaatattctgcacagaagtttttttttccccttttttcaattaacaggatgagggttctaataaaatcagggaaaagaaacatggtcaacttttaccaatgggggggatgaagagtgcttcgctcatacgggtgtagcccttatttgcatagttttgcagggatatgaaagattatttcccaactcacagcactttttaaagttgttatttatcacgaaagttatgtggtcatctacaaaatgttgttgaaaatgatttgatgcatatggccaatggcattaataaccaggggatagccaaagttcactttta

SEQ ID NO: 3259 - DNA, 3454 bp, Citrus clementina
ccacttttgcgcaccacacgccctctcaccctctctctttcatcttaaaataacagaacagaagacgccatgaattgaaagagcattattgccatcaaccgaccaataatcaaatccatctgagactctgtaccaaatccttatctcttgttttttgcctttccgttttgtgtgaatgcgtgatccaagacatatacgtacctcaccatcgtcatgtatataacaacctccacctcagcagcttcttcactcctcagagcttcttctaggtcacgattcgtctcttcgctatcttcatttaagtccttacctgcacgttctctttctccttctccttctccttctccttcatcgttggtctctcagcgatctctcggcttcgcctcggccgttcgatccttccgctgctccgtccctcgctggagccaccgcgttgactggcgctctccgcttagtcttcgcgctcagatcagaaccgttgctcctgccatcgaacggctcgaacgcgcctttgctactatggctgctgaacatccattcaaggagatcttgaccgctcttccaaagccaggaggtggcgagtttggaaagttctatagccttcctgcactcaatgatccaagaattgagaagctgccatactctatcagaatcctgcttgaatctgctattcgtaattgtgacaactttcaagttaagaaggaagatatcgagaaaattattgactgggaaaattctgcaccaaagcaagttgaaattcccttcaagcctgctcgtgtattgttgcaggattttactggagtaccagccgtggttgaccttgcctgcatgcgtgatgctatgaacaagcttggcagtgattccaacaagatcaatcctcttgttcctgtagatcttgtcattgatcattcggttcaggttgatgtaacaagatcggaaaatgcagttaaggcaaatatggaatttgaatttcagaggaacaaggagagattcgctttcctcaaatggggatctagtgctttccataacatgcttgttgttcctcctggttctggtattgtgcatcaggtcaatcttgaatatctgggacgggttgttttcaataccaacggcatgctataccccgacagtgtggttggtactgattctcatacaaccatgattgatgggttgggagttgctggctggggtgttggaggtatagaagcagaggctgcaatgcttggtcagcctatgagcatggtgttgcctggtgttgttgggttcaagctttctggaaagttgcacaacggggtcacagctactgaccttgttttaactgtaacgcaaatgcttaggaaacatggtgttgttggaaaatttgttgagttccatggggatggtatgggtgaactttcacttgctgacagagctaccattgctaatatgtctcccgagtatggagcaaccatggggttcttccctgtggatcatgttactttacaatatctcaaattgactggaaggagtgatgagacactggcaatggtagaaggctatcttcgagcaaataaaatgtttgtcgactacaatgagccccaacaagaaagggtgtactcatcatacctagaattgaaccttgctgatgttgagccttgtatttcgggaccaaagagacctcatgatcgggttcccttgaaggaaatgaaggcagattggcattcatgtcttgacaataaagtcggcttcaagggctttgctgtacctaaagagacacaggaaaaagtggtcaagttttcattccatggacagccagcagagcttaagcacgggagtgtcgtgattgctgcaatcacaagttgcaccaatacatcaaaccccagtgttatgcttggtgctggtcttgttgccaaaaaggcttgtgaacttggtttgcaggtcaagccatgggttaaaacaagtcttgccccaggctcaggagttgttactaaatatttactccagagtggactgcaaaaatatttaaatgagcaaggattccatattgttggatatggatgcacaacatgtattggaaattcaggggatctggatgaatctgttgcatctgctattactgacaatgacattgtggcagcagctgtgctttctggaaacaggaattttgagggtcgtgttcatcccttgacaagagctaattaccttgcttctcctcctttagttgtggcatatgcccttgctggcacggttgacatagattttgataaggagccgattggaacaaccaaggatggtaagagtgtttatttcaaggatatctggccgactacagaagaaattgcagaggttgttcaatccagtgtgttgccagacatgttcaaaagtacctatgaggctatcacaaagggaaatcccacttggaatcagttatctgtaccagctagtaaactctattcttgggaccctaactcaacctacattcatgaacctccttacttcaaggacatgactatggatcctcctggagcccatggagttaaggatgcctactgcttgctgaactttggtgacagtatcactacagatcacatttctccggcaggaagtatccacaaagacagtcccactgcaaagtacctgctagagcgtggtgtggaacgcagggacttcaattcttatggtagtcgtcgtggcaatgatgaagtgatggctagaggaacttttgcaaatatccgtcttgttaacaagctcttgaatggggaagtgggtccaaagacggtccatgttccaacaggggagaaactctctgtgtttgatgcagcaatgaaatacaagagtgctggtcatggtacaattatcttggctggagctgaatatggaagtggaagttcccgtgattgggctgccaagggtccaatgttgttgggagttaaagcagtgatcgccaaaagttttgaaagaattcatcgcagtaatttggttggaatgggtatcattcctctctgtttcaaggctggtgaggatgcagactcattgggtttgactggtcatgagagatttagtattgatctcccaagtaagatcagtgaaataagacctggccaagatgtgactgtcaccactgacagtggaaaatcctttacctgcacagtccgttttgacacagaggtagaattggcttactttgatcatggaggcatccttccgtttgtcattcgcaacctgattaagcagtaaataactgcatcatttctactaggcggacttgcttcatccaaagaaacttacggttgtaaaatgtgagagttgaataaagttcaaataatgtaagaaagatccctttgatgggacttgagtctttttttctgggaacaattcaaaaggtcgatatctttgttctgtgaacgaagaattattttcattaatacaattcttttcctgtttgatgatcaaaaaaaaaaaaaaaaaaaaaaaa

SEQ ID NO: 3260 - DNA, 1752 bp, Sorghum bicolor; identical to SEQ ID NO: 3237

SEQ ID NO: 3261 - DNA, 1900 bp, Zea mays; identical to SEQ ID NO: 3236

SEQ ID NO: 3262 - DNA, 2271 bp, Hordeum vulgare subsp. vulgare; identical to SEQ ID NO: 3238

SEQ ID NO: 3263 - DNA, 1779 bp, Oryza sativa Japonica Group; identical to SEQ ID NO: 3239

SEQ ID NO: 3264 - DNA, 364 bp, Sorghum bicolor
ccctcgcggtacttgttcgctatcggtctctcgcctgtatttagccttggacggagtttaccgcccgatttgggctgcattcccaaacaacccgactcgttgacggcgcctcgtggtgcggcagggtccgggccggacggggctctcaccctcccaggcgtccctttccagggaacttgggcccggtccgtcgctgaggacgcctctccagactacaattcaggtgacgaagccacccgattctcaagctgggctggtcccggttcgctcgccgttactaggggaatccttgtaagtttcttctcctccgcttatttatatgcttaaactcagcgggtggtcccgactgacctggggtcgcggt

SEQ ID NO: 3265 - DNA, 411 bp, Sorghum bicolor
cgctatcggtctctcgcctgtatttagccttggacggagtttaccgcccgatttgggctgcattcccaaacaacccgactcgttgacggcgcctcgtggtgcggcagggtccgggccggacggggctctcaccctcccaggcgtccctttccagggaacttgggcccggtccgtcgctgaggacgcctctccagactacaattcaggtgacgaagccacccgattctcaagctgggctggtcccggttcgctcgccgttactaggggaatccttgtaagtttcttctcctccgcttatttatatgcttaaactcagcgggtggtcccgactgacctggggtcgcggtccgagcaacgatgtgctgcggtgcccgaagggtccttagggccgatgcaccggccacgtgtcgg

SEQ ID NO: 3266 - DNA, 276 bp, Sorghum bicolor
cggagtttaccgcccgatttgggctgcattcccaaacaacccgactcgttgacggcgcctcgtggtgcggcagggtccgggccggacggggctctcaccctcccaggtgtccctttccagggaacttgggcccggtccgtcgctgaggacgcctctccagactacaattcaggtgacgaagccacccgattctcaagctgggctggtcccggttcgctcgccgttactaggggaatccttgtaagtttcttctcctccgcttatttatatgcttaa

SEQ ID NO: 3267 - DNA, 276 bp, Sorghum bicolor
cggagtttaccgcctgatttgggctgcattcccaaacaacctgactcgttgatggtgcctcgtggtgcggcagtgtccgggccggacggggctctcaccctcccaggcgtccctttccagggaacttgggcccagtccgtcgctgaggacgcctctccagactacaattcgggtgacgaagccaccagattctcaagctgggctggtcccggttcgctcgccgttactaggggaatccttgtaagtttcttctcctcctcttatttatatgcttaa

SEQ ID NO: 3268 - DNA, 276 bp, Sorghum bicolor
cggagtttaccgcccgatttgggctgcattcccaaacaacccgactcgttgacggcgcctcatggtgcggcagggtgcgggccggatggggctctcaccctcccaggcgtcccttgccagggaacttgggcccggtctgtcgctgaggacgcctctccagactacaattcaggtgacgaagccacccgattctcaagatgggctggtcccggttcgctcgacgttactagggaaatccttgtaagtttcttctcctccgcttatttatatgcttaa

SEQ ID NO: 3269 - DNA, 1834 bp, Sorghum bicolor
aaacagcaagaaccaccaaggcgactccgatctaaatcaagcgagtcctcccgtttcatcgcctgcgaaaaaggcgagaaatccccaacggaaggagcagcagcgccagtgctactgctagcagcagaagcagcagcgattcgttcctcaatcctcgtacctctcgccgcgctcgcccactcggatcgaaacccctagggtttcgcatcggcctcccgccacttcctatccctccccctcccctccctccgccgcgcgcgcgcggcgagtcaccaaaccctaggacggcaaatccggtgcgatcgcccacggtggaggcctcctcggctgccgagaggagccgctcagggctcgggtcagggttccggtacctcgccggcgccgcctctgggtggtgggaccggtggatggtcatgggagccagcggctccaagcttgagaaggccctcggtgaccagttcccggaaggcgagcgctacttcggcctcgagaacttcggcaacacctgctactgcaacagtgtccttcaggcactctatttttgcattccatttagggagcagttactggaatattatgcaaataacaaaactccaggtgacgctgaagaaaatcttttgacctgtttggccgacctttttatgcagataagccaagcaaagaaaaagactggcgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgccaaggattcaccccaattgtcatctcctgaaaaagctccaaatggcccagttcaacctttagccaatggagttaaaaaagaacctccagttactctggtccataaaaatttccagggcatattgaccaacgaaacaagatgcttaagatgtgaaacagtaactgcaagggatgaaacatttcttgatcttagtgttgacattgaacaaaatagttctatcacaagctgcctgaaaaatttctgttctactgagactttaaatgcagaggataaattcttctgcgacaaatgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggaaacacagaccatgggtatatcttattttacgaggggcttggcgggaagagttagatggggtttattcaccttccctgttccttttctcctttttctctttggagcttgcaagttcactcttgtacctacacagctactatttcattacctccatggaatcgaagaggttgtatgaggtgaggacgccagattttgggtggtttcagtgtacaggggataatggaatctagctcccaacgatgaaataaggtgtaatttttaagttcgcctgaccagtttcttctcagggctaacatcttttgttaaagagtgggactttactattggacacactgtacatcaattctagttcataactctgcgcatttaccagt

SEQ ID NO: 3270 - DNA, 1714 bp, Zea mays
tgagtcaagcgtcttcccatttcatcgcctggaaaaaggcgagaaaccccgaagtgaaggaacagcagcacgagtgctagcagcagcagcgattccttcgccataccgttcgccgcgctcgctcactcggatcgaaccctccctagggtttcgcatcgtcctcccgccaactcctatccctcccccctccctccgccgcgcgcgcgcggggagctaccaaaccctaggacggcaaatccggtgcgatcgcccacggtggaggcctcgtcggccgccgagaggagccgctcggggctcgggtcagggttccggtacttcgccggcgccgcctctgggtggtgggaccggtggatggtcatgggagccagcggctccaagcttgagaaggccctcggagaccagttcccggaaggcgagcgctacttcggcctcgagaacttcggcaacacttgctactgcaacagtgtccttcaggcactttatttttgcattccattcagggagcagttactggaatattatgcaaataacaaaactccaggtgacgttgaggaaaatcttttgacttgtttggccgacctttttatgcagataagccaagcaaagaaaaagaccggtgttattgctccaaaacgttttgttcagagagtgaagaaacagaatgagttgtttcgcagctacatgcaccaggatgcacacgagttcttaaattttcttttgaatgaacttgttgatattctggaaaaagagtcaagtgctgctaaggactcaccccaatcatcatctccagaaaaagctccaaatggcccagttcaacctttagccaatggagttaaaaaagaaccaccagttactctggtccataaaaatttccagggcatattgaccaatgaaacaagatgcctaagatgtgaaacagtaactgcaagggatgaaacgtttcttgatcttagtgttgacattgaacaaaatagttctatcacaagctgcctgaaaaatttctgttctacagagactttaaacgcagaggataaattcttctgtgacaaatgctgcagtttgcaagaagcacagaagagaatgaagatcaagaaggctccccacatactggtgatccatctaaagcgtttcaagtacattgagcagcttggccggtataagaagctttcataccgggttgtattccccatggaactgaagctcagtaatacatctgacgatgtagacactgagtattccctctttgctgtcgtggtccatgttggaagtggccccaaccatgggcactatgtaagccttgtcaaaagccacaaccactggttgttcttcgatgacgaaaacgtcgagatggttgaagagcagaccctacaaacattcttcggttcctcacatgaatactcaggcaacacagaccatgggtatatcttgttttatgaggggcttggtgggaagagttagatgggtttattcatcttccttgtttcttttctccttttctctttggagcttgcaaattcactcttgtgcctacacagctactatttcattacctccatgggaaacgggtcaatcgaaggggtgttgtatgaggtgaggacgccagattttgggtggtttcagtgtacaggggataatggaatctagctccaacgatgaaataaggtgtattttttttaacttctcagggctaaagagttggactttactattgagc

SEQ ID NO: 3271 - DNA, 1931 bp, Zea mays
cggagcaagaaacctctctgttgaagtgctgatgatggattacaatgaatttcagtccacagcagaaaaaaaaaaccccggttagatctgtgtagaaagagtaaagaaatacagataggcccggggtccacaggtccagtgaaatgcttgcccacgaacagaaacagcaagaaccaccacaaggcgagtccgattctagatcaagcgagtcctcccgtttcatcgcctcggaaaaaggcgagaaatctgcaacagaagaagcagcagcgacagcgattccttcctcgtacctttcgttgcgctcgcgcactcggatcgacccctctagggttttgcatcggcctcccgccagctcctatccctcccctctccctccgccgcgcgcccgcgcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccgatggatggtcatgggagccagcggctccaagcttgagaaggccctcggagaccagttcccggaaggcgagcgctacttcggcctcgagaacttcggcaacacctgctactgcaacagtgtccttcaggcactttatttttgcattccattcagggagcagttactggaatattatgcaaataacaaaactccaggagacgctgaggaaaatcttctgacttgtttggccgacctttttatgcagataagccaagcaaagaaaaagaccggtgttattgctccaaaacgttttgttcagagagtgaagaaacagaatgagttgtttcgcagctacatgcaccaggatgcacatgagttcttaaatttccttttgaatgaacttgttgatattctggaaaaagagtcaagtgctgctaaggactcaccccaatcgtcgtctcctgaaaaagctccaaatggcccagttcaacctttagccaatggagttaaaaaagaaccaccagttaccctggtccataaaagttttcagggcatattgaccaacgaaacaagatgcttaagatgtgaaacagtaactgcaagggatgaaacatttcttgatcttagtgttgacattgaacaaaatagttcaatcacaagctgcctgaaaaatttctgttctacagagactttaaatgcagaggataaattcttctgtgacaaatgctgcagtttgcaagaagcacagaagagaatgaagattaagaaggctccccacatattggtgatccatctaaagcgtttcaagtacattgagcagcttggccggtataagaagctttcatacagggttgtattccccatggaactgaagctcagtaattcatccgacgatgtagacactgagtactccctctttgctgtcgtggtccatgtcggaagtggcccgaaccatgggcattatgtaagccttgtcaaaagccacaaccactggttgttcttcgacgatgaaaatgtcgagatggttgaagagcagaccctacaaacattcttcggtacttcacatgaatactcaggcaacacggaccatgggtatatcttgttttacgaggggcttggtgggaagagttagattggtctattaacctttcctgttcctttttttccttctctttggagcttgcaagttccactcttgtacctacacagctactatatcattacctccatggaaaacggtcaatccaagaggttgtatgaggcgacgatgccagattttgggtggtttcagtgtacaggggataatggaatctagctcccaacgatgaaataaggtgtaattttgaagttcgcctgaccagttccttctcagggctaacatcttctgttaaagtgtgggactttactattgggcacactgt

SEQ ID NO: 3272 - DNA, 1686 bp, Zea mays
aagaaccaccacaaggcgagtccgattctagatcaagcgagtcctcccgtttcatcgcctcggaaaaaggcgagaaatctgcaacagaagaagcagcagcgacagcrattccttcctcgtacctttcgttgcgctcgcgcactcggatcgacccctctagggttttgcatcggcctcccgccagctcctatccctcccctctccctccgccgcgcgcccgcggcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccggtggatggtcatgggagccagcggctccaagcttgagaaggccctcggagaccagttcccggaaggcgagcgctacttcggcctcgagaacttcggcaacacctgctactgcaacagtgtccttcaggcactttatttttgcattccattcagggagcagttactggaatattatgcaaataacaaaactccaggagacgctgaggaaaatcttctgacttgtttggccgacctttttatgcagataagccaagcaaagaaaaagaccggtgttattgctccaaaacgttttgttcagagagtgaagaaacagaatgagttgtttcgcagctacatgcaccaggatgcacatgagttcttaaatttccttttgaatgaacttgttgatattctggaaaaagagtcaagtgctgctaaggactcaccccaatcgtcgtctcctgaaaaagctccaaatggcccagttcaacctttagccaatggagttaaaaaagaaccaccagttaccctggtccataaaagttttcagggcatattgaccaacgaaacaagatgcttaagatgtgaaacagtaactgcaagggatgaaacatttcttgatcttagtgttgacattgaacaaaatagttcaatcacaagctgcctgaaaaatttctgttctacagagactttaaatgcagaggataaattcttctgtgacaaatgctgcagtttgcaagaagcacagaagagaatgaagattaagaagactccccacatattggtgatccatctaaagcgtttcaagtacattgagcagcttggccgttataagaagctttcatacagggttgtattccccatggaactgaagctcagtaattcatccgacgatgtagacactgagtactccctctttgctgtcgtggtccatgtcggaagtggcccgaaccatgggcattatgtaagccttgtcaaaagccacaaccactggttgttcttcgacgatgaaaatgtcgagatggttgaagagcagaccctacaaacattcttcggtacttcacatgaatactcaggcaacacggaccatgggtatatcttgttttacgaggggcttggtgggaagagttagattggtctattaacctttcctgttcctttttttccttctctttggagcttgcaagttccactcttgtacctacacagctactatatcattacctccatggaaaacggtcaatccaagaggttgtatgaggcgacgatgccagattttgggtggtttcagtgtacaggggataatggaatctagctcccaacgctgaaaaaaaaaaaaaaaa

SEQ ID NO: 3273 - DNA, 1734 bp, Oryza sativa Japonica Group
agggtagtagactagtagtaggcgaaagaaaaaaaaaatccccccaaacgagagaagcggcagcgacgacgacgacgacggcgacagcagcagcggcggcagaagcagcagaagcaaccccctcctccgccgctccgccccatcggatcgaggccgccctagggtttcccccaggctccgcccctccgcttcccccctctccgccgcgcgcgcgcggggagccaccaaaccctaggacggcaaacccggcgcgatcgcccacggtggaggcctcgtcggcggccgagaggagccgctccgggctcgggtcggggttccggtacctcaccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtcctccaggcactatatttctgcatcccgttcagggagaaattgctggaatattatgcaaataacaaaactcctggagatgcggaggagaaccttttgacttgtttggcggatcttttcatgcaggtaagccagtcaaagaaaaagactggcgttattgctccaaaacgctttgtccaaagagtaaagaaacagaatgaactatttcgcagctacatgcaccaggatgcacatgagttcttaaattttctgttgaatgagcttgttgatattctggaaaaggagtctaatgctgcgaaggactcccctcaatcatcatctcctgaaaaggttccaaacgggccagttcaacctttagccaatggtgttagaaaagaaccaccggttaccttggtgcataagaattttcagggcatactgaccaatgagaccagatgcttaagatgcgagacagtaacagcaagggatgaaacattttttgatctgagtgttgatattgagcagaatagttctatcacaagctgcttgaaaaacttctgctccacggagactttaaatgctgaggacaaattcttctgtgacaaatgctgcagcttgcaagaagcacagaagagaatgaagatcaagaaggctccacacatattagttatccacctaaagcgcttcaagtacatagagcagcttggtcggtataagaagctttcataccgggttgtattcccaatggagctgaagctcagtacatctgatgatgtagataccgagtactccctctttgctgtcgttgtccatgttggaagtggccccaaccatggacattatgtaagccttgtcaaaagccacaaccactggttgttcttcgatgatgaaaatgtcgagatggttgaggagtcgaccctgcaaacattcttcggttcttcacatgaatactcaggcaacacggaccatggatacatcttgttttatgagggtcttggtgggaagagttagattgattttcttcaccttccctgttcttttcttttttttttctttggagcatgcaagaataccgttgtatttacacagctatttcattacctccatggaaaattgttgatctcagagattgtgagtatgaacatgaggacgctggattttgggtggttttagtgtacagagcataatggaaccttgctcctagtggtgaaataaggtgtaaatcattaagtacgcctgacttttttttttcgtcagcattgacatctttaccaaagaatgc

SEQ ID NO: 3274 - DNA, 1662 bp, Hordeum vulgare subsp. vulgare
cgtcaaaatacatgttccactcggcagccagacttttccccctccaccatcccgtacctttcctcttccttcccgatccactcctctcccacgctgctctcatactctgacctacccaagcccaagctccaatccatccaaacccaacgagctcctaaaatctcctcccatacgccaccgccgccgtgccctggagctaagcgtcaccgccggcgcctcacccacccaactccttcgccccccacgcgcgtcgccgccatcgccgccctcgtttctaccccgtcgcgtcaccgctgactccacccccgcctgcatatccgacatcggttcttgagatccgccctggcctcctcggcggccgagaggagccgctccgggctcgggtcaggtttccggtacctcaccggagccgccaccgggtggtgggaccggtggatggtcatgggagccagcggctccaagctcgagaaggccctcggcgaccagttccctgaaggcgagcgctacttcggactcgagaactttggcaacacctgttactgcaacagtgtactccaggcactttatttctgcactccgttcagggagcagttactcgaatattatacgaataacaaaaatcctggagacgcagaggaaaaccttttgacttgtttggcggatcttttcatgcaggtaagtcaatccaagaaaaagacaggcgttattgctccaaaacgttttgtccaaagagtgaagaaacaaaatgaattatttcgcagctacatgcaccaggatgctcatgagttcttaaattttctcctgaatgagcttgttgacattctggagaaagagtccagtgctgcgaaggactccccccaatcatcatctcctgaaaaggttccaaatgggccagtccaaccattggccaacggagttaaaaaggagccgcctgttaccttggttcataagaatttccagggcatactgaccaatgaaaccaaatgcttaagatgtgagacagtaactgcaagggacgaaacgttttttgatctgagtgttgacattgagcagaatagttccattacaagctgcctgaaaaatttcagctccactgagactttaaatgctgaggacaaattcttctgtgacaaatgctgcagtttgcaagaagcacagaagagaatgaagatcaagaaggctccccatatattggtgatccacctaaagcgctttaagtacattgagcagcttgggcggtataagaagctttcatatcgggttgtattccccatggagctgaagatgggcagtacatctgatgatgtagataccgagtattctctctttgctgtagtggtccatgttggaagcggccccaaccatggccattatgttagcctcgttaaaagccacaaccactggctgttcttcgatgatgaaaacgtggagatggttgaagagtcgaccctgcaaacattcttcggttcttcgcatgagtactcaggcaacacagatcatggatacatcttgttttacgagggccttggtgggaagagtttaggttgattttcccggttgtttttcttttcttttttctttggagcatgcaagcttactgttgtatgtacacagctatttcatcacctccatggtaaattgttaatctcagagattgtgagt

SEQ ID NO: 3275 - DNA, 1256 bp, Vitis vinifera
atttcgctgccaattccctctggaagaaaccctaacgttcgaaaatagagaaaaagggttgaagagcgtttttggatggtgaaggaattcctgagttgaaacggacgatcgatccgagtcgccgtggttatttgctcaatcctccgatgggcgctgcaggttcgaagctcgagaaagctcttggcgatcagttccccgaaggcgagcgatacttcgggctcgagaattttggcaacacttgctattgcaacagcgtcttgcaggctctttatttttgtgttccatttcgtgaacaattgctagaatattacacaaataacaaaaatctcgcagatgcagaagaaaatctattgacatgcttggcagacttattcatgcagataagctcacagaagaagaaaacaggtgttattgcaccaaagcgttttgtacagaggctgaagaaacaaaatgagctttttcgcagctatatgcaccaggatgcacatgaatttttgaacttcttgctaaatgaacttgttgacatactggagaaggaggcttctgcttcaaaaagtgatccagaaacctcatccccacctgagaagactgcaaatgggccaaagactgctcaggctaatggtgttcagaaagagcctctagttacctgggtgcacaaaaattttcagggtatactcacaaatgagacaaggtgcttgcggtgtgaaacagtcacagcaagggatgaaacatttttggacttgagcctggatattgaacagaacagttccatcacaagctgtctgaaaaattttagctcaacagaaactttgaatgcagaggacaaatttttctgtgacaaatgctgcagtttacaagaggcccagaaaagaatgaagataaagaaaccacctcacatactggtcatccatttgaagcggttcaagtacattgagcagctgggcaggtacaagaagctatcttaccgggttgttttcccgcttgagctgaagctgagcaatacagtagaagatgcagattctgaatattccctctttgctgtggttgttcatgttggaagtgggcccaaccatgggcactatgtgagccttgtgaaaagtcataaccattggttattttttgatgatgaaaatgtggagatgattgatgagtcttccgtgcaaactttctttgggtctgcacaggagtattcgagtaacactgatcatgggtacatcttgttctatgagagccttgctacaaatgacaagagctaa

SEQ ID NO: 3276 - DNA, 1202 bp, Ricinus communis
aaaacattgaaacagcgaagataaacaaaatagaaaacagaaaagtgtagaaactattgaatcggagagaatatcaataaatcgatgcagtaatgggagcagcaggctctaaactcgagaaagctctgggcgaccagtttcctgaaggcgaacgatactttggcctcgagaattttggaaacacttgttactgtaacagcgtcttgcaggcactttatttttgtgtaccttttcgagaacaattactagaatattatgcaaataataaaagtggtggagatgctgaagagaaccttttgacatgcttggcggacttatttacacagataagttcacagaagaaaaaaacaggtgtaattgctccaaagcgttttgtacagagattgaaaaaacaaaatgagctttttcgtagctatatgcaccaggatgctcatgaatttctgaatttcttactaaatgaacttgttgacatactggagaaggaggctcaagctgccaagagtgatccagaaacttcatcctcgcctgagaagattccaaatgggcccaagaatggtcaggcaaatggtgtttcaaaggagcctttagtgacctgggtgcacaaaaattttcagggaattcttaccaatgagacacgatgcctgcagtgtgagactgttacagcaagagatgaaacatttttcgacttgagccttgatattgaacagaacagttcgataacaagctgtttgaaaaattttagttccacagagaccttgaacgcagaggataagtttttctgtgacaagtgctgcagtttgcaagaagcccagaagaggatgaagataaagaaaccccctcacatcttggtcatccatttgaagaggttcaaatacattgagcagctgagccggtacaagaagctatcctatcgagttgtattcccacttgagctgaagctgagtaacacagtagaagattcagacattgaatactcattatttgcagtagttgttcatgttggaagcgggcccaatcatggacactatgtcagccttgtgaaaagccataatcactggctgttttttgatgacgaaaatgtcgagatgattgatgagtctgctgtgcaaactttctttgggtcatcacaggaatattcgagtaatacggatcatgggtacatcttgttttacgagagccttggtgctagtaacaagagttga

SEQ ID NO: 3277 - DNA, 1188 bp, Sorghum bicolor
atggacgctcctctgctcgtgaccttcctcgtcgtcgtccccgtggcggtggtggtggcgctcctcgtggcgtcggcgtccgcggcggcgccgcgcgccttcttcgtgttcggggactccctggtcgacaacggcaacaacaactacctgatgaccacggcgcgcgccgacgcgccgccgtacgggatcgacttccccacgcacatgcccacggggaggttctccaacgggctcaacatcccggacatcatcagcgagcacctcggctcccagcccgcgctgccgtacctcagcccggacctccgcggcgaccagctgctcgtcggcgccaacttcgcctccgccggcgtcggcatcctcaacgacaccggcatacaattcgtgaacatcatcaggatcgggcagcagctgcagaacttccaggactaccagcagaggctggccgagttcgtcggcgaggacgcggcgaggcaggtcgtcaacaacgcgctcgtgctcatcacgctcggcggcaacgacttcgtcaacaactactacctggtgccattctccgtccggtctcgccagtttgccatccaagactacgtcccctacctcatctccgagtacaggaaaatcctcacgcggctgtacgagctcggggcccggcgcgtggtggtgacgggcacggggatgatcgggtgcgtgccggcggagcttgccatgcacagcatcgacggcgagtgcgcgcgcgacctcacggaggcggccgacctcttcaacccgcagctggtgcagatgctctcccagctcaacgccgacatcggcggcgacgtcttcatcgccgccaacaccaaccgggtcagcttcgacttcatgttcaacccgcaggactacgggttcgtgacgtccaaggtggcgtgctgcggtcagggcccgtacaacgggatcgggctgtgcacgccggcgtccaacgtgtgccccaaccgggacgtgtacgcgtactgggacgcgttccaccccacggagcgcgccaaccggatcatcgtcggccagttcatgcacggctccaccgaccacatcacccccatgaacatcagcaccatcctcgccatggacaacacacagcagggactaggcctacctgctgctgctgctgctgcctcgctccatcccatctctccctggctagctgacgtccatccgtga

SEQ ID NO: 3278 - DNA, 1399 bp, Zea mays
ccgctcgatcgcgcccccatcaatcaatcaatcaattctcgacctcactactcgatctctcgtctcatcagtgtgactgtgtgagtgtccgagcacggtagcacgcgcaatggacgctctgctcgtgactaccttcctcgtccccgtggtggcgctcctcctcggttccgggtccgggtccgcggcaccgctgccgcgcgccttcttcgtgttcggtgactccctcgtggacaacggcaacaacaactacctgatgacgacggcgcgcgccgacgcgccgccctacgggatcgacttccccacgcacatggccacggggaggttctccaacgggctgaacatccccgacatcatcagcgagcacctgggctcccagcccgcgctgccgtacctgagccccgacctccgcggcgcccagctcctggtgggcgccaacttcgcgtccgccggcgtcggcatcctcaacgacaccggcatacagttcgtgaacatcatcaggatcggacagcagctgcgcaacttccaggagtaccagcagaggctggcggcgttcgtcggcgaggacgcggcgcggcaggccgtcagcgacgcgctcgtgctcatcacgctcggcggcaacgacttcgtcaacaactactacctggtgcccttctccgtccgctctcgccagtttgccatccaagactacgtcccctacctcatctccgagtacaggaagatcctcacgcggctgtacgagctcggggcccggcgcgtggtggtgacgggcaccgggatgatcgggtgcgtgccggcggagctcgccatgcacagcgtcgacggcgagtgcgcgcgcgacctcacggaggcggccgacctcttcaacccgcagctggtgcagatgctctccgagctcaacgccgacatcggcgccgacgtcttcatcgccgccaacaccaaccgggtcagcttcgacttcatgttcaacccgcaggactacgggttcgtgacgtccaaggtggcgtgctgcgggcagggcccctacaacgggatcgggctgtgcacgccggcgtccaacgtgtgccccaaccgggacgtgtacgcgtactgggacgcgttccaccccacggagcgcgccaaccggatcatcgtcggccagttcatgcacggatccaccgaccacatcagccccatgaacatcagcaccatcctcgccatggacaacaggaactaggccctgcgcgtggcgtgcctcgacctcgatccatccatctctagccggctgggattgagatgccaatctgcactgccatggatccgtcccgacactggcagctataatactacgagacgacacacatagctactgcatgcatgcgtaatactactagtataagttcgtgcaaaaaaaaaaaaaaaa

SEQ ID NO: 3279 - DNA, 1628 bp, Zea mays
acctggccgctccatctcgcgtccaacaatcaattcggcgtcgctctcgtctcatcagtcatcactccgcgactgcgagcgagcgagcgaggcccttccgcgccacgcgcaatggacgctgctctgctcgtgaccgtcctcgtccccgcggtggcggcgctcctcgtcctcgggtccggggccgcgtccgcctcgccgccgcgcgccttcttcgtgttcggggactccctcgtggacaacggcaacaacaactacctcatgaccacggcgcgggccgacgcgccgccctacgggatcgacttccccacgcacctgcccacggggcggttctccaacgggctcaacatccccgacatcatcagcgagcacctcggctcccagcccgcgctgccgtacctcagccccgacctccgcggcgaccagctgctcgtcggcgccaacttcgcgtccgccggcgtcggcatcctcaacgacaccggcatacagttcgtgaacatcatcgggatcgggcagcagctgcacaacttccaggactaccagcagaggctggccgcgttcgtcggcgacgacgcggcgaggcaggtcgtgagcaatgcgctcgtcctcatcacgctcggcggcaacgacttcgtcaacaactactacctggtgcccttctccttccgctcccgccagttcgccatccaagactacgtcccgtacctcatctccgagtacaggaaaatcctcacgcggctgtacgagctcggggcccgtcgcgtggtggtgacgggcaccgggatgatcgggtgcgtgccggcggagctggccatgcacagcatcgacggcgagtgcgcgcgcgacctcacggaggcggccgacctcttcaacccgcagctggtgcagatgctctccgacctcaacgcggccatcggcggcgacgtcttcatcgccgccaacaccaaccgcctcagcttcgacttcatgttcaacccgcaggactacgggttcgtgacggccaaggtggcgtgctgcgggcagggcccgtacaacgggatcgggctgtgcacgccggcgtccaacgtgtgccccaaccgggacgtgtacgcgtactgggacgcgttccaccccacggagcgcgccaaccggatcatcgtcgcccagttcatgcacggctccaccgaccacatcagccccatgaacatcagcaccatcctcgccatggacaacaggggggactaactagtcccgccgcgtgctgcctccacccatctcgtcattggttggttcacgccaagaggttttgctgcattgcatgtgtcatggagctggtggataacaagttttcgttgcacctttttgtgatttattagatgacgtgaattagtggtgaattgagccttattagagtgggttaaattaatacagctgtcccaagtttctttgctccagcagattgtttggggacagggctagctaggaacttcagaaattgctaagcggtactacctagccagtccgtccgatcatttcaagaaaattctcttgcactttgtagtgtgatcctgaacttttgggtacaaggtaccgacgattcaatgccaatgtatattttggtggctggggcacagtgaaaaaaaaaaaaaaaa

SEQ ID NO: 3280 - DNA, 1565 bp, Zea mays
cgcgtccaacaatcaattcggcgtcgctctcgtctcatcagtcatcactccgcgactgcgagcgagcgagcgaggcccttccgcgccacgcgcaatggacgctgctctgctcgtgaccgtcctcgtccccgcggtggcggcgctcctcgtcctcggggccgcgtccgcctcgccgccgcgcgccttcttcgtgttcggggactccctcgtggacaacggcaacaacaactacctcatgaccacggcgcgggccgacgcgccgccctacgggatcgacttccccacgcacctgcccacggggcggttctccaacgggctcaacatccccgacatcatcagcgagcacctcggctcccagcccgcgctgccgtacctcagccccgacctccgcggcgaccagctgctcgtcggcgccaacttcgcgtccgccggcgtcggcatcctcaacgacaccggcatacagttcgtgaacatcatcgggatcgggcagcagctgcacaacttccaggactaccagcagaggctggccgcgttcgtcggcgacgacgcggcgaggcaggtcgtgagcaatgcgctcgtcctcatcacgctcggcggcaacgacttcgtcaacaactactacctggtgcccttctccttccgctcccgccagttcgccatccaggactacgtcccgtacctcatctccgagtacaggaaaatcctcacgcggctgtacgagctcggggcccgtcgcgtggtggtgacgggcaccgggatgatcgggtgcgcgccggcggagctggccatgcacagcatcgacggcgagtgcgcgcgcgacctcacggaggcggccgacctcttcaacccgcagctggtgcagatgctctccgacctcaacgcggccatcggcggcgacgtcttcatcgccgccaacaccaaccgcctcagcttcgacttcatgttcaacccgcaggactacgggttcgtgacggccaaggtggcgtgctgcgggcagggcccgtacaacgggatcgggctgtgcacgccggcgtccaacgtgtgccccaaccgggacgtgtacgcgtactgggatgcgttccaccccacggagcgcgccaaccggatcatcgtcgcccagttcatgcacggctccaccgaccacatcagccccatgaacatcagcaccatcctcgccatggacaacaggggggactagtcccgccgcgtgctgcctccacccatctcgtcattggttggttcatgccaagaggttttgctgcattgcatgtgtcatggagctggtggatgacaagttttcgttgctcctttttgtggtttatcagatgacgtgaattagtggtgaattgagccgagtgggttaaatacaactgtcccaagtttcttcgctccagcagattgtttgagggcagggctagctaggaacttcagaaattgctaagcggtactacctagccagtccgtccgatcatttcaagaaaattctcttgcactttgtagtgtgatcctgaacttttggggtacaaggtaccgacaattcaatgccaatgtatattttggtggct

SEQ ID NO: 3281 - DNA, 1451 bp, Zea mays
acctcactactcgatctcgtctcatcagtgtgagtgtccgagcacggcagcacgcgcaatggacgctctgctcgtgactacgaccttcctcgtccccgtggtggcgctcctcctcgggtccgggtccgggtccgcggcggcgctgccgcgcgccttcttcgtgttcggtgactccctcgtggacaacggcaacaacaactacctgatgacgacggcgcgcgccgacgcgccgccctacgggatcgacttccccacgcacatggccacggggcggttctccaacgggctgaacatccccgacatcatcagcgagcacctcggctcccagcccgcgctgccgtacctgagccccgacctccgcggcgcccagctcctggtgggcgccaacttcgcgtccgccggcgtcggcatcctcaacgacaccggcatacagttcgtgaacatcatcaggatcgggcagcagctgcgcaacttccaggagtaccagcagaggctggcggcgttcgtcggcgacgaggacgcggcgcggcaggccgtcagcgacgcgctcgtgctcatcacgctcggcggcaacgacttcgtcaacaactactacctggtgcccttctccgtccgctctcgccagtttgccatccaagactacgtcccctacctcatctccgagtacaggaagatcctcacgcggctgtacgagctcggggcccggcgcgtggtggtgacgggcaccgggatgatcgggtgcgtgccggcggagctcgccatgcacagcgtcgacggcgagtgcgcgcgcgacctcacggaggcggccgacctcttcaacccgcagctggtgcagatgctctcggagctcaacgccgacatcggcgccgacgtcttcatcgccgccaacaccaaccgggtcagcttcgacttcatgttcaacccgcaggactacgggttcgtgacgtccaaggtggcgtgctgcgggcagggcccctacaacgggatcgggctatgcacgccggcgtccaacgtgtgccccaaccgggacgtgtacgcgtactgggacgcgttccaccccacggagcgcgccaaccggatcatcgtcggccagttcatgcacggatccaccgaccacatcagccccatgaacatcagcaccatcctcgccatggacaacaggaactaggccctgcgcgtggcgtgcctcgacctccatccatccatccatccatctcaatcccagctggctagctgctaatctgccattgatccgtccgcgtccggacactggcagctatactacgactacgacgacacacatagctactgcatgcatgcgtaatactactagtataagttcgtgtcattggtaattggttatgttcatgaagcttcttttttgtggtttagattgacgtgaattgatggtgagaaattaatcctttattagagatgcatgggttcaatat

SEQ ID NO: 3282 - DNA, 1931 bp, Oryza sativa Japonica Group
gcatgcacatgatccgaggcacagcaaggcagggcagggcagggccgggccagccaagtggcctccgagggcgagatgcgtacgcggggacgcaacgcgaagcgccgcatttagcatccaaccaccctgcatctgcggcgtgcagcagcaaaaacaactagcttgcgtgcttggtcaggcgcgcgcgcgcgagagagaagaggggtgtgtggtgtggtggtcctcgcgcgcaattgctttccgtgtcccgcgccccgctaactcactgctcacgccttaactgcgcgtcttaaggtggcgtggcgcgagacatcgatgcgaattgcgaacgcgaatgcggcctccctctataagagagatcgcaagcgagaacgtgaacgccgccaccctcgcgccgtccatacatccaccgtcgtgtcgcccactgtccaactgccagtcagctagccccaagtgtatactctcagctgctgtcgcgagtctcgccgacgtacgcgcgcgatgggcgcttcttctttggttggattcctcatggcggcggtggcggcgctgctcgtggccgccgcgacgccggcggcggcggcgccgagggcgttcttcgtgttcggggactcgctcgtggacaacggcaacaacaactacctcatgacgacggcgcgcgcggacgcgccgccgtacgggatcgacttcccgacgcacatgcccacggggagattctcaaacgggctcaacatcccggacatcatcagcgagtacctcgggtcccagcctgctctgccgtacctgagcccggacctccgaggcgagaaccttctcgtcggcgccaacttcgcctccgccggcgtcggcatcctcaacgacaccggcatccagttcgtgaacataattaggatcggtcagcagctggacaacttcgagaactaccagcggaatctggcggcgttcgtcggcgaggacgcggcgaggcaggtggtgcagcagtcgctcgtgctcatcacgctcggcggcaacgacttcgtcaacaactactacctggtgccattctccgtcaggtcccgacagttcgccatccaggattacgtcccctacctcatctccgagtacaggaagatcctcacgaggctgcacgatctgggtccgcgtcgggtgatcgtgacgggcaccgggatgatcgggtgcgtgccggcggagctggccatgcacagcatcgacggcgagtgcgccaccgacctgacgcgcgccgccgacctcttcaacccgcagctggagcgcatgctcgccgagctcaactccgagctcggcggccacgtcttcatcgccgccaacaccaacaagatcagcttcgacttcatgttcaacccccaggactacgggtttgtgacggcgaaggtggcgtgctgcgggcaggggccgtacaacggtatcgggctgtgcacgccggcgtccaacgtgtgcgcgaaccgggacgtgtacgcgtactgggacgcgttccacccgacggagcgggcgaaccggctcatcgtcgcgcagatcatgcacggctccaccgaccacatcagccccatgaacctcagcaccatcctcgccatggacgagaggaggaattgatcgatctcatcaggcattcacaggacactactactttgcccagagagtacatcatatttactactacattacaatgtgtggctggctgtatgtgcttaatagtgctggttcaagttttgaagttttctctctaccttctttgatttttctggtttaggtgaaagtgatggtgaatctggtttaggggtgaaagtaagtaagtaatgggtgaattaagagcctacagtgggttgtgttttgttaatgttgcaagggtacttattggatagtgggggtttaaggcatgtgttttctcctcggttatcaggtggagaatttgtttg

SEQ ID NO: 3283 - DNA, 1529 bp, Hordeum vulgare subsp. vulgare
gggtgtccacgacgtacgcgccttgccaagtcgcagccacccactggagctcgccagttccatagctactcgtgcgacacgagtcgtcgcgccgaggtccgccatggacgcttgctctcaggccctcgccgtcgtcgcggcgctgctcctcctcgtcggggcctcggcgccgacggcgtccgcggcgcgcgccttcttcgtcttcggcgactccctcgtcgacaacggcaacaacaactacctcatgacgacggcgcgcgcggacgcgccgccctacggcatcgacttccccacgcacatgcccacggggaggttctccaacgggctcaacatccccgacatcatcagcgagtacctcggggcagagccggcgctgccgtacctgagcccctacatgcgcggcgacaacctgctcgtcggcgccaacttcgcgtccgccggcgtcggcatcctcaacgacacaggcgtgcaattcgtgaacatcatcaggatcgcgcagcagctgcagaacttccaggactaccagcggaggctggcggcgtacatcggcgaggacgcggcgaggcagcgcgtgagccagtcgctggtgctcatcaccctcggcggcaacgacttcgtcaacaactactacctggtgcccttctccgccaggtcccagcagttcgagatccacgactacgtccccttcatcgtctccgagtacaagaaagtcctcgcgaggctgtacgagctgggcgcccgtcgcgtgatcgtgacggggacggggatgatcgggtgcgtgccggcggagctggccctgcacagcctcgacggctcctgcgcgccggacctcacgcgggccgccgacctcttcaacccgcagctggagcggatgctgacggagctcaacggcgaggtcggccacgacgacgtcttcatcgccgccaacaccaacagggtcagctttgacttcatgttcaacccgcagcagtacgggttcgcgacggccaagatcgcgtgctgcgggcagggcccgtacaacgggatcgggctgtgcacgccggcgtccaacgtgtgcgccaaccgtgacgcctacgcctactgggacgcattccaccccacggagcgggccaaccggatcatcgtcgccaacttcatgcacggcaccaccgaccacatcagccccatgaacctcagcaccatcctcgccatggacaacaccaggaactagtcttacaccgctaggtactaggatctgtgtcggcccggcctacatatatatatatatagctacatatatatgtatggtgcttaatttgttattggtctctccgtatgaacctggctggactggagcgggtggtctacaagtttttgacgggtccgtccttggtttggtcgagacttgagagtaatgtgggtgttaactaagagagattgcttattttctgtttgctgctccacattgtttagcagagctagtggctaggaaattgtaagacagcggtttttacgtaccggattgatccaagaattccttgtagcttgtg

SEQ ID NO: 3284 - DNA, 723 bp, Zea mays
atggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagacgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatga

SEQ ID NO: 3285 - DNA, 1268 bp, Zea mays
tctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctaaaaaaaaaaaa

SEQ ID NO: 3286 - DNA, 803 bp, Oryza sativa Japonica Group
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 3287 - DNA, 1175 bp, Hordeum vulgare subsp. vulgare
gaagttgcagagccaccagcagaagactcctctccccttcctcttcctctctctcccctccaatcagcctatctgggaaacctgggaactttctccttccagagctccggcagctagatccacccagcttatctctgcaccggggtagctcgctctccgcgtgtgggaggtatttgaagatggggcggggcaagatagtgatccggcggatcgacaactccacgagccggcaggtgacgttctcgaagcggaggaatgggatcttcaagaaggccaaggagctgggtattctctgcgatgccgaggtcggtctcgtcatcttctccagcaccggccgcctctatgagtacgccagctccagtatgaagtcagtgatagatcgatatggccgagcgaaggaggagcagcaacttgttgcaaaccccaactcggagcttaagttctggcaaagggaggcagcaagcttgagacaacaactgcacaacttgcaagaaaatcatcggcagttgatgggacaagatctttctggaatgggtgtcaaggaactgcagactctagaaaatcaactggaaataagtctgcgttgcatccggacaaaaaaggaccaaatcttgattgatgagattcatgaactgaatcacaaggggagtcttgtccaccaagaaaacatggaattgtacaaaaagattaacctaatccgtcaagaaaatgttgagttacacaaaaagctctctgagacggaggcagcaactgaagttaaccgagattcaagaactccatacaattttgcagttgttgaagatgccaatgtttctgttaatcttgaactcaattccccacagcaacaaaatgatgttgagcatactgcaccgcctaaactaggattgcaactacatccatgacgatcgtggggtatgggattactcttgttgttattattctcaagggatacaattcagagcagccagaatactattggttgtaaagaacctaaacccatagcaagacataagtggttcgcatgtgacgagcgattgataaatctgtcagtgtaaatctgttacaaataaaatgtactccatggaaggattaatcagttgtgctaatggttgtattagaactatttaacacattatgcgagtttgttcaattgcatgagcggctagcttattgac

SEQ ID NO: 3288 - DNA, 1118 bp, Triticum aestivum
cctgggaactttctccttccagagctccggcagctagatccacccagcttatctatttccatcgccctcttgctctgcaccgggtagcttagcttgtcctctgcgtgtgggaggtagttgaagatggggcgcggcaagatagtgatccggcggatcgacaactccacgagccggcaggtgacgttctcgaagcggaggaacgggatcttcaagaaggccaaggagctgggtattctctgcgatgccgaggtcggtctcgtcatcttctccagcaccggccgcctctatgagtacgccagctccagcatgaagtcagtgatagatcgatatggccgagccaaggaggagcagcaacttgttgcaaaccccaactcggagcttaagttctggcaaagggaggcagcaagcttgagacaacaactgcacaacttgcaagaaaatcatcggcagttgatgggacaagatctttctggaatgggtgtcaaggaactgcaggctctagaaaatcaactggaaataagtctgcgttgcatccggacaaaaaaggaccaaatcttgattgatgagattcatgaactgaatcacaaggggagtcttgtccaccaagaaaacatggaattatacaaaaagattaacctaattcgtcaggaaaatgttgagttacagaaaaagctctctgagacggaggcagtgactgaagttaaccgaaattcaagaactccatacaattttgcagttgttgaagatgccaatgtttctgttgatcttgaactcaattccccgcagcaacaaaatgatgttgagcatactgcgccccctaaactaggattgcaactacatccatgacgatcgtggggtatgggattactcttgttattattattatcaagggatacaattcagagcagccagaatactattggttgtaaagaacctaaaccaatagcaagacataagtggttcgcatgtgacgaccgattgataaacggtagtgtaaatctgttacaaataaaatgtactccatggaaggattaatctgttgtgcaaatggttgtattagaacaatttaacacattctgtgagtttattcaactgcatgagcagctagcttactgaca

SEQ ID NO: 3289 - DNA, 803 bp, Oryza sativa Japonica Group; identical to SEQ ID NO: 3286

SEQ ID NO: 3290 - DNA, 1268 bp, Zea mays; identical to SEQ ID NO: 3285

SEQ ID NO: 3291 - DNA, 723 bp, Zea mays; identical to SEQ ID NO: 3284

SEQ ID NO: 3292 - DNA, 1175 bp, Hordeum vulgare subsp. vulgare; identical to SEQ ID NO: 3287

SEQ ID NO: 3293 - DNA, 1118 bp, Triticum aestivum; identical to SEQ ID NO: 3288

SEQ ID NO: 3294 - DNA, 1565 bp, Zea mays; identical to SEQ ID NO: 3280

SEQ ID NO: 3295 - DNA, 1628 bp, Zea mays; identical to SEQ ID NO: 3279

SEQ ID NO: 3296 - DNA, 1399 bp, Zea mays; identical to SEQ ID NO: 3278

SEQ ID NO: 3297 - DNA, 1451 bp, Zea mays; identical to SEQ ID NO: 3281

SEQ ID NO: 3298 - DNA, 1188 bp, Sorghum bicolor; identical to SEQ ID NO: 3277

SEQ ID NO: 3299 - DNA, 1931 bp, Oryza sativa Japonica Group; identical to SEQ ID NO: 3282

SEQ ID NO: 3300 - DNA, 1529 bp, Hordeum vulgare subsp. vulgare; identical to SEQ ID NO: 3283

SEQ ID NO: 3301 - DNA, 876 bp, Zea mays
cgcaatattctgatcttctatctccttccaccgtttgcaagaagggctagcttagcgcacctccttgacgaggcggagagcagcgctggcgagaagggctcagcgcacctccttgatgcggcggagagcggcgtcggcatcaagggctcagcgcaggcggcggcctccacatccctccatccatggttagaagctacgatggagacgacggagggcagctgcaaggaatctcccgtcgcgcagacggtcgccgtggaaggcagagacagagaatctgacagaaagaaccgcgagcacctttgtgcggaagccctctcgcagctgccgggctccaagattgacggggagtacgaccccttaatgcttgacctcttcgtctaccggcgtgccgttgctccgcgggacaccgcctgggagagtgccccattggtcctccacgacgagggactcatcacagtcagggttggctggcctccacatgaacccgagcagccatgggacctagtggaagctatgacgaggatccttggccaccatccgggcccagtatcttcgttccgcctccattcgtcgctctcgcccgacgtggacacgctgggctgctggatggatttgctctcagagaagggagtcgcagagttgattatcttcaacttgtaccaggacgtatcgaccgcgcagctgccgttgcaacgtctcacatcgtaccaccagtgcgcacgtatgtgacagttgatcgcattaacttccatcgtatcctcgcagtcgcagtcgcaggcggcagacaacctcgatccatatgaaaattagagtatactaaggttgtctgcatcagattatacatatgattgtgtaatttaacacttagaattctcg

SEQ ID NO: 3302 - DNA, 950 bp, Zea mays
gcaaaatctctagtctcggcatttccttcctcgcaatattctgatcttctctctccttccaccgtttgcaagaagggctagctcagcgcacctccttgacgaggcggagagcagcgctggcgagaagggctcagcgcacctctttgatgtggcggagagcggtgtcggcatgaagggctcagcgcaggcgacggcctccacatccctccatccatggctagaagctacgatggagacgacggagggcagctacaaggaatcccccgtcgcgcagacggtcgccgtggaaggcggagacagagaatctgacagaaagaaccgcgagcacctttgtgcggaagccctctcgcagctgccgggctccaagattgacggggagtacgaccccttaatgcttgacctcttcgtctaccggcgtgccgttgctccgcgggacaccgcctgggagagtgccccattggtcctccacgacgagcgactcatcacggtcagggttggctggcctccacatgaacccgagcagccacgggacctagtggaagctgtgacgaggatccttggccaccatccgggcccagtatcttcgttccgcctccattcgtcgctctcgcccggtgtggacacactgggctgctggatggatttgctctcagagaagggagtcgcagagttgattatcttcaacttgtaccaggacgtatcgaccgcgcagctgccgttgcaacgtctcacatcgtaccaccagtgcgcacgtatgtgacagttgatcgcattaacttccatcgtatcctcgctgtcgcaggcggcagacaacctcgatccatgtgaaaattagagtatactaaggttgtctgcaccagattatacatatgattgtgtaatttaacacttagaattcccgaaaaaaaaaaaaaaaaaaaaaaaaaaaaaaagaaaaaaaaaaaaaaaac

SEQ ID NO: 3303 - DNA, 739 bp, Zea mays
gccgcctcttcctctcggttaagtccagcccactccgccgccgccgaccgcgagaggagttctcttcgccgcctcaaggacgagatggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatggaagtttatggaattgctgaaaacagccagaccatccgcgctgaagtttgcacagattttggtcctgactttgatcccgagacttttaatcaattgtgcaacctggcgagtaacaagttcaagcacatgttcctgtagaggtcatcatcaagtggaggaccttcggccaactgaagcttgtttgaaatcgatatgattcacctctaaatgttctttcactcaccccagtactctgttgtcagtattggactccttttagcatgtattaatctaagcaacataagactacgaaggcaagcaaaatatatcgtgtagttgaagaacgtatggtcttttctacttttaggcaatcccaaagctaagcttgttatgttgctgtcacttacatttggaccctgagaagttgctacaatggctaatgcagcttgatgagaggaaagagttctaatgtgaaagaaaaaaaaaaaaaaaa

SEQ ID NO: 3304 - DNA, 857 bp, Zea mays
acgagatggatgtctcagatgctaaaatgagcacttgagcaccgtagccgtctgagcacgatatgttcttaaaaaaagcaaatttgccgtctgcaaaacccctcccacagccgtcgccgcccgccagcccgccagcgagagaagtccgcttcatccgttcgccgcctcaaggacgagatggacacatcaagccctgcagcacttgtcaatgcacagatgctgaacatgtttgttgggcgaagagtgcgcacggttgttcaagtccaacacaatgaaggtggagtgcttgtcgggcagtccaccgatgggcaccagttgtgtgtcaaaagtgccatggacgtccccgtatcacattttatggaggtttatggaattgctgaaaacagccagaccatccgtgctgaagtttgcacagattttggtcccaactttgatcccaaggtttttgatgagttgtgcaagctggcgagtggcaggttcaagcacctgttcctgtagagataatcatygcatggaggatyttcarccmactgaagcttgtttgaaactgaatgtttygcctttaaatttaagatttggstacatgttccttcattgcatggaggaccttcagtaccctgttactygtcagtattggacttytattagcatgtataagcaacataggactgcgaatacaagcaaaatatatcatgtagttgaagaacctatggtytttttytacctttaggcaatccaaccctaagctttttatgttgctgtcgcttgcatttggaccctgagttgctacaattgtcatggagtttgatgagaagaaaaatgattytaatatgstagttcgaaaaaaaaaaaaaaaa

SEQ ID NO: 3305 - DNA, 379 bp, Sorghum bicolor
ccacagcggcgcctcctctcccgtctcttccgttcggtcaagcccagcccactccgccgtcgccgcccgcgagaggagtccgcttcatccgattcgccgcctcaaggacgagatggacacatcaagccctgcagcacttgtcaatgcagagactctgaacatgtttgttgggcgaagagtgcgcacggttgttcaagtccaacgcaatgaaggtggagtggttgtcgggcagtccagcgatgggcatcagttgagtatcaaaagtgccatggacgtccctgtatcaaactttatggaggtttatggaattgctgaaaacaaccagaccatccgtgctgaagtttgcacagattttggtcccaactttgatccaccttag

SEQ ID NO: 3306 - DNA, 1392 bp, Sorghum bicolor
attcctctcctcttctttcccccaaaaccctaacccctcctcggttccacctctcgccggcgccggcaagatgactctcctcgcagccatcaccaaccccgccgccggctccctccccggctcaagcgagaaggcacaccctatcgtgctcactccgggtgccgcgccaccgccgccgacatcctccgcgctcccgaccccaatcccgccctccgcctggtcgctctcccccgctgaccgcaccttcgccaccgccgcctcctacctcgcaacctccctcgactcctgctcctccctcccgcgcctccgtctccttctcaccaacttcgtcgccacgctgtcccaatccctcgcactcccaacaccgccgccggccatccccgccgccatccgcgccgtcgccccttacttccccgccgctatcgcctcccttgtggcctccaaggcggcaagcctcgccgagcacgacatcctcctcgctctcgcggaatcccgcctcctacgtcacccgccaccggaactcatctcgtcgctctgcgacaacgaccgggtcgaccttgtctgcgccttgctccgccaggccgccgacatccgctcttccgagatcctcgccgcgctccgctgcttcctctcgccggcctccgagaaggcctacgacgccatgatggacgtcaagggccggtggaaggacgccgcggtgctcgcagtcaacaggtgtcgggagaagagcgccgggaagaagaagaatgccgacgctgcggcgaggcgggcggcgctgctgctcatgatggggcacgacgggttcacctctccggaggtgtgcctgcattacctattcgcatcagggaatgtggattccgtggtgcttggagcggctgtggctgaacttgatggcggggaggtagtcaggctgatgaggtacctcaacaagtggattgggaagtaccggaggttctcagaagcacgcacgtgcccggaggctgtggaaaacctcggattggagcagtgtcaaagtgtgccatcgtttggagcagtggctagggcgctgggagtgctgctggataatcatttctcccaccttgtgttgaatgctgatgtgagggaggacttgagggctgcagagttgatggtgagggagctcgctgccgaagcggagtcttctgggccaatcctggacttgctgcataggttgcagctggataagtgagagattaatcttgttctcttgaatctatttaccttttgtagctctgaagctgatgtatggcaattttgactgttttggttacattgcagtgatgagatatgtgttgcggtattgaatattgaagtataatagtacatgttggttggaaactgatgttttcagatttcattgtagtgatcctgtag

SEQ ID NO: 3307 - DNA, 1277 bp, Zea mays
ccaaaaccctaacccatcgtcgaccggtccccgctctcgtggcgccggcaagatgaccctcctcgcagccatcaccaaccccgccgccgactcccgctccggctccagcgagagggctcaccctatcgtgctcacgccgggtgtcacgccgccgccgccgccatcctccacgctccccaccccaataccgtcttccacctggtcgctctccccagccgaccccaccctcgccaccgccgcttcctacctcgcggcctcgcttgcctcctgctcctccctcccgcagctccgcgcccttctcaccacctttatcaccactctgtcacgatccctcgcactcccaaccccgccggcggccctccccgccgccatccgcgctgtcgccccttacttccccgccgcaatcgcctcccttgtggcctccaaggcggtaagcctcgccgggcacgacatcctccttgctctcgcggaatcccgcctcctcccgcacccgccaccggaactcatctcgtcgctctgcgacaacgactgggtcgaccttgtctgcgtcttgctccgccaggccgccgacatacgttcctccgagatcctcgccgcgctccgttgcttcctctcgccggcctccgataaggcttacgacgccatgatggacgtcaagtgccgatggaaggacgccgcggtgcttgctgtcaacaggtgtcgggagaagagcgccgtgaagaggaagaaagttgacgctgcggcgaggctcgcggcgctgctgctcatgatggggcacgatgggttcacctccccagaggtgtgtctgcattacctatttgcatcagggaatgtggattccgtggtgcttggagcggctctggctgaacttgatggcggggaggtagtcaggttgatgagatatctcaacaagtggattcggaagtactggagcttctcggaagcgcacacttgcccggaggctgtggaaaacctcagattggagcagtgtgacagcgtgccatcgtttggagcagtggctagggcgctaggagtgctgctggataatcatttttcacatcttgtgttgaatgctgatgtgagggaggacttgagggctgcggacttgatggtgagggagctcgctgccgaagcagagtcttctgggccaatcccagacttgctgcataggtttcaactggataagtgagaggttgatcttattctgtcgaaactatttacttttttgtacttccaaagccgatgcatggaaacttttaactgttttattgcattgc

SEQ ID NO: 3308 - DNA, 1361 bp, Zea mays
ctctcctcttctctccccgcgcccctccctctcccccaaaaccctaacccatcgtcgaccggtccccgctctcgtggcgccggcaagatgaccctcctcgcggccatcaccaaccccgccgccgactcccgctccggctccagcgagagggcccaccctatcgtgctcaccccgggtgtcccgccgccgccgccgccatcctccacgctccccaccccaataccgccttccacctggtcgctctccccagccgaccctaccctcgccaccgccgcttcctacctcgcggcctcgcttgcctcctgctcctccctcccgcatctccgcgcccttctcaccacctttatcaccactctgtcacaatcactcgcactcccaaccccgccggcggccctccccgccgccatccgcgctgtcgccccttacttccccgccgcaatcgcctcccttgtggcctccaaggcggtaagcctcgccgggcacgacatcctccttgctctcgcggaatcccgcctcctcccgcacccgccaccggaactcatctcgtcgctctgcgacaacgaccgggtcgaccttgtctgcatcttgctccgccaggccgccgacatacgttcctccgagatcctcgccgcgctccactgcttcctctcgccggcctccgacaaggcttacgacgccatgatggacgtcaagtgccgatggaaggacgccgcggtgcttgctgtcaacaggtgtcgggagaagagcgccgtgaagaggaagaaagctgacgctgcggcgaggcacgcggcgctgctgctcatgatggggcacgatgggttcacctccccagaggtgtgcctgcattacctatttgcatcagggaatgtggattccgtggtgcttggagcggctctggttgaacttgatggcggggaggtagtcaggttgatgagatatctcaacaagtggattcggaagtactggagcttctcagaagcgcacacttgcccggaggctgtgggaaacctcagattggagcagtgtgacagcgtgccgtcgtttggagcagtggctagggcgctaggagtgctgctggataatcatttttcacatcttgtgttgaatgctgatgtgagggaggacttgagggctgcggacttgatggtgagggagctcgctgccgaagcagagtcttctgggccaatcctagacttgctgcataggtttcaactggataagtgagagattgatcttattctgtcgaaactatttacttttgtacttccaaatgccgatgcatggaaatttttaactgttttattgcattgcagtgatgagatacatgttgcagcattgaatattcaaaaaaaaaaaaaaaa

SEQ ID NO: 3309 - DNA, 1324 bp, Zea mays
cccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctatcgtgctcacgccgggtgtcacgccgccgccgccgccatcctccacgctccccaccccaataccgtcttccacctggtcgctctccccagccgaccccaccctcgccaccgccgcttcctacctcgcggcctcgcttgcctcctgctcctccctcccgcagctccgcgcccttctcaccacctttatcaccactctgtcacgatccctcgcactcccaaccccgccggcggccctccccgccgccatccgcgctgtcgccccttacttccccgccgcaatcgcctcccttgtggcctccaaggcggtaagcctcgccgggcacgacatcctccttgctctcgcggaatcccgcctcctcccgcacccgccaccggaactcatctcgtcgctctgcgacaacgactgggtcgaccttgtctgcgtcttgctccgccaggccgccgacatacgttcctccgagatcctcgccgcgctccgttgcttcctctcgccggcctccgataaggcttacgacgccatgatggacgtcaagtgccgatggaaggacgccgcggtgcttgctgtcaacaggtgtcgggagaagagcgccgtgaagaggaagaaagttgacgctgcggcgaggctcgcggcgctgctgctcatgatggggcacgatgggttcacctccccagaggtgtgtctgcattacctatttgcatcagggaatgtggattccgtggtgcttggagcggctctggctgaacttgatggcggggaggtagtcaggttgatgagatatctcaacaagtggattcggaagtactggagcttctcggaagcgcacacttgcccggaggctgtggaaaacctcagattggagcagtgtgacagcgtgccatcgtttggagcagtggctagggcgctaggagtgctgctggataatcatttttcacatcttgtgttgaatgctgatgtgagggaggacttgagggctgcggacttgatggtgagggagctcgctgccgaagcagagtcttctgggccaatcctagacttgctgcataggtttcaactggataagtgagaggttgatcttattctgtcgaaactatttacttttttgtacttccaaagccgatgcatggaaacttttaactgttttattgcattgcagtgatgagatacgtgttgcagcattg

SEQ ID NO: 3310 - DNA, 3691 bp, Oryza sativa Japonica Group
atctcctccaaaaccctaacccctccactttctcttctcgcgccggcgccatgacgctcctcgccgccatcaccaatccctccgccgccgccgccgccgccgccgtcgcggcgaaccccatcgtcctcactcccggcgccgctccgccaccgccgacctcctccgcgctccccacccagatcccgccctccgactggtccctctcccccgccgaccccgccctcgccaccgccgcctccttcctctccacctccctctcctccacctccgtctccctcccgcgcttccgctccctcctcgcctccttcctcaccaccctctccaactccctctccctccccgccccctcccccaacctcccacaagccatccgctccgtctccccctacttccccgccgccctcgcctcccccgtcgcctcccgagcggcgagcctcgctgagtacgacgtcctcctcgccctcgccgagtgcggcctcctccgccaccccccgccgagcctcctttcctcgctctccgaggccgaccgccccgagctcgtctgcgccgtggtccgacaggccgccgacctccgctcctccgagctgctcgcgacgctccgctgcttcctctcgccggcctccgatgccgcctacgacgccatgatgagtgtcaagaaccggtggaaggaagccgcggtgctagcggtcaacaggtgcaaggagaagggcgcggggaagaaggtcgatgccatggcgaggcaggcggcgctgctgctcatgatgggatacgatgggttcacctcaccggaggtgtgcctgcattacctgtttgcgtctgagaatgtggactctgtggtcttcggcgcagccgtatcggagctggatggtggggaggtggtcaggctgatgaagtacctcaccaagtggatagggaaataccagaggttcccagaggcgcaggcatgcccagaggctgtgggaatgccagggctggagctgtgtgacattgtgccctcatttcgggtggtggctggggcgctaggattggtgtttgaccagcacttctcgcacctagcgctgaatgcagagttgaaggaggatttgaaggccgcggagatgatggtgaaacagctggccacagaagctgaatctgcagggcctatcctggacttgcttcgacgtatgcagcaagatgtgtgagacactaaaatgtgcccctcaattttttttactgatcttagctgttatgctcatgtccgagaattttgattgttttactgcattgcagtgatgagttatgtgctctattatctaatatcatagtatgataatggtacatgttctgtttggaacccgacatgtctttgagtggtattactacactgctagctagattgtcactcccttagttggtatgccctgcgatgtgctaatgcccgctggccactgctagttaaattgatgtgtaaaagcaccatttacaaatgcaaattcaaatgtgtcgtggtagttaactttctgatattatgtgggaagagaagcttcaaaatgctgccatttctcatatgagtaactaaattcgtcattcataacccaagccaattgaaatacaaaattgttcaaatagtttagaacttccgacaacaaacattttcatacataactactttaacattactgaaaactcatatatttgcttctttcgtttaattcatttccattgttgggtctgactgaggtgataaagcttaattcgttgacaaatttacttcttgtacataaaactgaatagtccttagaaccaattgtatctgtgacttcaatggttgaaggagagagaaattgattggctgttctgcatattctttgtgaaaatcaaataaggctgaacttgttgacaatctttcttcttgtgtgtaaagctgaacaatcctcacaatcaattgtttctgggacttcaaagggttgaatgagggtgaaattaattggctcttctgcatatgttttgtgaaaatgactctgtttatcagtactcagtagtcagtacaaatagttcagttgaaaacgtaaagatgacagcctaaatatataaagtttttcctagtctatgctgtttctgggaattcagaacataatcaattctacatgactttatgcaataattggtcttgatgctttccaatatgcttcttttttctgtaagagggatctacttgtagtcttaatagtgtccaaggaaatcgattctcactgatctgatcttataatctgaattcttgtttcttagatcagtgttcaaataaggaagcccttgatgtgcttcaccttactgcttgaaggaactaaatattttttcctaaatatatttgagaatgctgatcatacctcatcatttcaaatgctgaccaagtattccatcagacaaaatgatagagctacctaccaggtagttacttgtatgatcctcactaagtcactaatttgtttccaaattgctgaattttagattctggtatcctgtgttcgatccagttttgtgatttaagattattcattactacttgatcttttgacaggtttaagcttgacagtattacctctggtatctttttagtgtaaaatggtgcccatttttaattatgaggttacatgtcttaagtaatgctcaaatattctgaccttcttgtaaatttactttgaattggacacacccatgtgtaagatgtgaaatgctggattcacattttttgaagtacaaaagaaaaaggtgcatgcactgggagcctgcctcatgcctattgaccaatttaaacgacagtgaagacgagagtgcaacagatgactggtgccataggcagtagaaaaaggaagagaaatggagcataccagccaaagttgaagacgttctcaaccaagcgggctatcttgggatagcagaatagctgccaaagttgaagacgttgtcaaaacaagcggctatctttgtgttttctggtcccaaggtatgatactccagctctcctgtttaccccatcttagaaaaaggaaaaatgtcatcttttgcatattgaaagtggtaggtaaggcagttcaatcttcaatcttcccaaaacgagctcaagcttcctaaaagtttctttttattaaagaagtaaactttccatttatgttcatctgagaaaattctatacaattagttagtgcctcgagtacattttagtttgatgcgtcacttcttttgcttcagttagcaactaagctcgctgatattatctaggtctcatggattattaaattgtttttggttgttggctagctgggtttgcaatcgtccccttccccagtttagatatatggggtatactttgtgagattttctctcatcctttgagatgtatgtacctcatccttgagatatacctctccataaaaagaggtaccaaaattaatctaacaggttggaaaaggattgaaaacttatctttataaatatttcagactttttttttttacattttctagcggtatagatatttgattaagaggtatatacctcaggactaacactataacactatgaggtatatgtacctctctatacctcagaacgactagaaaagtcttgccagtgctaatcataaacttgttttctaatcagttaaaccggtataattttttacctctcaaattgtgaggtatatacctctccc

SEQ ID NO: 3311 - DNA, 1849 bp, Zea mays
atctccgtgggcaattgctggctggcctagctagctagaagtatctcatatccgggtataggagtatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatgtttgtcgtggagccctacaacggcagcttgccgcgcctgcgctacaacccaaactcgtggacaaaggtggcgcatattctttttgtggattcaccagttggggccgggttttccttctccagagatgccaaaggttacaacgctggagcggtatcaaccacgatgcacttggcgaagttcctcaccaagtggttcaatgaccatcccgagtaccatgcaaatcctttctacatcgatggagaatcatacgctggaaaaattgtaccattccttgcacagatgatttcagaaggtattgaagcaggaatgaagtcggcacctcgtctcaagggctatctagtgggcaacccgtccacagaggagcgtattgatgttagcgctagagtgccttgtgctcacgggtttgggattatatcacatcagttgtatgagatgatattggggcattgccatggagaggactactccaatcctgcaaaagagttgtgtggtcaggcactgaagaccttcaataatctcacctccgaagttgcgcaaggccatgtactgcaggagaaatgcgtcgcggcgtcgtcgtctcctgtgccgaacgcaaacagcagggtggccggcggctcgtcgtcgtgggcctcagatggcaggaagatcctacgggaggaagaaatggtgggacgacgcggagtagtactgggcaagctatttcatccaccggctcttcctccattcagttgcagggtttaccggtactacctgtcgtatttctgggcaaacgacaggcgcacccgggatgctcttgggatcaaggagggcaccgtggatgagtgggtcagatgccacaacgacgaccaagagttgccttacgagagcgagctgaagagtgtcgtcaagtaccaccggaacctgacgtccagaggctaccgcgccctggtatacagcggcgaccatgacctgctggtgccacatctgggcacccaggcctgggtcaggtcgctcaacttccccgtcgtggacgactggagggcgtggcatctcggtggccagtcagctggatttacgacaacttactcaaacaacatgacattcgcgacgatcaagggcgccgggcatacggcgcctgagtacgagccggagaggtgtttcgccatgttcagccgttggatcctcaaccggccactctaatccatatgtgccttctcgcatcgaagatccatcagtgaatgaagagattcgtgtgtaaatctttcttcacgaaactactggctataagatgtacgtggatggaataaaatgctggctatgaacccttgatgctgatgatatatatatactccatcagtggtgaagccagatatgtattgtaggaataaataaaagtacaaaacggatgtacaaaggtacgtacagtgccctctagctacgctacattagcaatatacacgttcatacaaaaaaaaaaaaaaaa

SEQ ID NO: 3312 - DNA, 1836 bp, Zea mays
gcattgcattgcagtgtagcaggcatctccgtgggcaattgctggctggcctagctagctagaagtatctcatatccgggtataggagtatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatgttcgtcgtggagccctacaacggcagcttgccgcgcctgcgctacaacccaaactcgtggacaaaggtggcgcatattctttttgtggattcgccagttggggccgggttttccttctccagagatgccaaaggctacaacgctggagcggtatcaaccacgctgcacttggcgaagttcctcaacaagtggttcaacgaccatcctgagtaccatgcaaatcctttctacatcgatggagaatcatacgctggaaaaattgtaccattccttgcacagatgatttcagaaggtattggagcaggaatgaagtcggcacctcgtctcaagggctatctagtgggcaacccgtccacagaggagcgtattgatgttagcgctagagtgccttgtgctcacgggtttgggattatatcacatcagttgtatgagatgatattggggcattgccatggagaggactactccaatcctgcaaaagagttgtgtggtcaggcactgaagaccttcaatgatctcacctcggaagttgcgcaaggccatgtactgcaggagaaatgcgtcgcggcgtcgtcgtctcctgtgctgaacgcaaacagcagggtggccggcggctcgtcgtcgtgggcctcagatggcaggaagatcctacgggaggaagaaatggtgggacgacgcggagtactgggcaagctatttcatccaccggctcttcctccattcagttgcagagtttaccggtactacctgtcgtatttctgggcaaacgacaggcgcacccgggatgctcttgggatcaaggagggcaccgtggatgagtgggtcagatgccacaacgacgaccaagagttgccttacgagagcgagctgaagagtgtcgtcaagtaccaccggaacctgacgtccagaggctaccgagccatggtatacagcggcgaccatgacctgctggtgccacatctgggcacccaggcctgggtcaggtcgctcaacttccccgtcgtggacgactggagggcgtggcatctcggtggccagtcagctggatttacaataacttactcaaacaacatgacattcgcgacgatcaagggcgccgggcatacagcacctgagtacgagccggagaggtgtttcgccatgttcagccgttggatcctcaaccggccactctaatccatcggtgaatgaagagattcgtgtgtaaatctttcttcacgaaactactggctataagatgtacgtggatggaataaaatgctggctatgaacccttgatgctgatgatatatactccatcagtgtggtgaagccagatatgtattgtaggaataaataaaagtacaaaacggatgtacaaaggtacgtacagtgccctctagctacgctacattagcaatatacacgttcatatacataattttc

SEQ ID NO: 3313 - DNA, 1972 bp, Sorghum bicolor
atatagctactagtttgtccatccagtcgagccatcgttgtacgttgcacccatctgcgacggcaactgtaactcagctgcaagtacgtctaccagatgacgacggcggcacggccacgccgcctcctgcacccgcttggatgcctctgcttcctggtggtcgccgccttcgccgcctccatctcctccgccgccgggcgcgtggtcaccagcttgcctggcttcgacggcgacctccccttccacctcgaaacagggtacgtggaggtggacgaggacgccggcgtcgagctcttctactacttcgtccggtccgagtccgagtccgagtccggcgacgcccctttcctcttctggctcaccggcggcgaccgctgctccgtcttcagcggcctcgcctacgagattggtcccatcagattcgtcgtggagccctacaacggcacgctgccgcgcctgcggtacaaccaaaactcgtggtcaaaggtgtcacatatcctctttgtcgattcaccagttggagctggattttccttttccagagatcctaaaggatacgatgtcggagacatctcgtccacacagcagctacgtgacttcttaatcaagtggttcgatgatcatcccgagtaccttgcgaatcctttctacattggtggagactcctatgctgggaaaattgtaccattcattgggcagatgatttcagaaggtattgaggctggaaggaggccctttcctaatctgaagggctatctggttggtaacgcagccacaggcgaaagtattgatactacttctagagtgccctatgctcatggagttggtattatatcagctcaattgtatgagacgatattggggcattgccaaggagaggactacactaatcctgcaaatacgctgtgtgctcaggctctgtatactttcaacaatctcatcgatgaagttcagcatgcccacattttactggacaggtgcgtctacgcatctcctgcaccaaatgttgtgagcagaatggacggctcagataatagaaggatcttgagggcggagatgggaagagggatgctgaatcatccgccagctcgtcctccatttggctgcctcacttaccgctactacctgtcgtatttctgggcaaacgataaacgcactcgagaagctcttgggatcaagaagggaacagtggacgagtgggtgaggtgccacgatggagatctgccttacacgaaagacctcaagagttccatcaagtaccaccggaacctgacgtccagaggctaccgcgccctggtatacagcggcgaccatgacctgctggtgccacacctgggcacccaggcctgggtcaggtcgctcaacttccccatcgtcgacgactggagggcatggcatctcggtggccaagccgccgggttcacgataagttactccaacaacatgacgttcgcgacaatcaaaggtggtgggcatacggcgccggagtatgagccggagaggtgttttgccatgttcacccgctggatacttaacaatccactctaatatcaactcatgcatttgccggattcttgcactatcatggagacatggactactgtggattgctgctcataggcggaataaaatggatgattgctgtgatatgtgtaaactaggtctgtgtcagtgtgctgcccaggagccaaaaaaaatttcaacgtaataataagatgatcatacggggataaatcatgatggaaaatttcacaacattgccaaaagaagtactaaattgaaggacaaagcacattatatagtgaaatttgattatctcaatgacataataggttattaatcaaattaagacatctttttgtatttcaaaattttataaagtccaatcagtcatttttacatgtaataaagaaacagttgtgagacaacagtatgatcaatttataaattaaacttgtatttctttccagta

SEQ ID NO: 3314 - DNA, 1836 bp, Zea mays; identical to SEQ ID NO: 3312

SEQ ID NO: 3315 - DNA, 1849 bp, Zea mays; identical to SEQ ID NO: 3311

SEQ ID NO: 3316 - DNA, 1972 bp, Sorghum bicolor; identical to SEQ ID NO: 3313
